United States Patent
Dousis et al.

(10) Patent No.: US 11,485,960 B2
(45) Date of Patent: Nov. 1, 2022

(54) RNA POLYMERASE VARIANTS FOR CO-TRANSCRIPTIONAL CAPPING

(71) Applicant: ModernaTX, Inc., Cambridge, MA (US)

(72) Inventors: Athanasios Dousis, Cambridge, MA (US); Kanchana Ravichandran, Cambridge, MA (US); Amy E. Rabideau, Waltham, MA (US); Margaret Franklin, Cambridge, MA (US); Kevin Smith, Cambridge, MA (US); Michelle Lynn Hall, Roxbury, MA (US)

(73) Assignee: ModernaTX, Inc., Cambridge, MA (US)

( * ) Notice: Subject to any disclaimer, the term of this patent is extended or adjusted under 35 U.S.C. 154(b) by 0 days.

(21) Appl. No.: 17/325,883

(22) Filed: May 20, 2021

(65) Prior Publication Data

US 2021/0309976 A1   Oct. 7, 2021

Related U.S. Application Data

(63) Continuation of application No. PCT/US2020/018779, filed on Feb. 19, 2020.

(60) Provisional application No. 62/885,928, filed on Aug. 13, 2019, provisional application No. 62/832,314, filed on Apr. 11, 2019, provisional application No. 62/808,182, filed on Feb. 20, 2019.

(51) Int. Cl.
*C12N 9/12* (2006.01)
*C12P 19/34* (2006.01)

(52) U.S. Cl.
CPC ............ *C12N 9/1247* (2013.01); *C12P 19/34* (2013.01); *C12Y 207/07006* (2013.01)

(58) Field of Classification Search
CPC ........ A61K 2039/53; A61K 2039/5236; A61P 37/04; C12N 2710/20034; C12Q 2600/16; C12Q 2600/156
USPC ............ 435/6.1, 6.11, 91.1, 91.31; 536/23.1
See application file for complete search history.

(56) References Cited

U.S. PATENT DOCUMENTS

| | | | |
|---|---|---|---|
| 7,335,471 B2 | 2/2008 | Guillerez et al. | |
| 8,710,200 B2 | 4/2014 | Schrum et al. | |
| 8,754,062 B2 | 6/2014 | De Fougerolles et al. | |
| 8,822,663 B2 | 9/2014 | Schrum et al. | |
| 8,846,348 B2 | 9/2014 | Jendrisak et al. | |
| 8,916,352 B2 | 12/2014 | Cheng | |
| 8,999,380 B2 | 4/2015 | Bancel et al. | |
| 9,005,930 B2 | 4/2015 | Jendrisak et al. | |
| 9,045,740 B2 | 6/2015 | Martin et al. | |
| 9,115,380 B2 | 8/2015 | Jendrisak et al. | |
| 9,163,246 B2 | 10/2015 | Barnes | |
| 9,193,959 B2 * | 11/2015 | Sobek .................. C12N 9/1247 |
| 9,221,891 B2 | 12/2015 | Bancel et al. | |
| 9,283,287 B2 | 3/2016 | Bancel et al. | |
| 9,303,079 B2 | 4/2016 | Bancel et al. | |
| 9,464,124 B2 | 10/2016 | Bancel et al. | |
| 9,512,456 B2 | 12/2016 | Wang et al. | |
| 9,533,047 B2 | 1/2017 | de Fougerolles et al. | |
| 9,597,380 B2 | 3/2017 | Chakraborty et al. | |
| 9,868,691 B2 | 1/2018 | Benenato et al. | |
| 9,872,900 B2 | 1/2018 | Ciaramella et al. | |
| 9,950,068 B2 | 4/2018 | de Fougerolles et al. | |
| 10,034,951 B1 | 7/2018 | Roy et al. | |
| 10,064,934 B2 | 9/2018 | Ciaramella et al. | |
| 10,064,935 B2 | 9/2018 | Ciaramella et al. | |
| 10,124,055 B2 | 11/2018 | Ciaramella et al. | |
| 10,144,942 B2 | 12/2018 | Strack-Logue et al. | |
| 10,207,010 B2 | 2/2019 | Besin et al. | |
| 10,232,055 B2 | 3/2019 | Kariko et al. | |
| 10,273,269 B2 | 4/2019 | Ciaramella | |
| 10,286,086 B2 | 5/2019 | Roy et al. | |
| 10,385,088 B2 | 8/2019 | Fraley et al. | |
| 10,449,244 B2 | 10/2019 | Ciaramella et al. | |
| 10,465,190 B1 | 10/2019 | Chen et al. | |
| 10,493,143 B2 | 11/2019 | Ciaramella et al. | |
| 10,526,629 B2 | 1/2020 | Rabideau et al. | |
| 10,653,712 B2 | 5/2020 | Hoge | |
| 10,653,767 B2 | 5/2020 | Ciaramella et al. | |
| 10,695,419 B2 | 6/2020 | Ciaramella et al. | |
| 10,857,105 B2 | 12/2020 | Benenato et al. | |
| 10,898,574 B2 | 1/2021 | de Fougerolles et al. | |
| 10,925,958 B2 | 2/2021 | Ciaramella | |
| 2011/0081374 A1 | 4/2011 | Bublot et al. | |
| 2013/0102034 A1 | 4/2013 | Schrum et al. | |
| 2013/0236974 A1 | 9/2013 | De Fougerolles | |
| 2013/0245103 A1 | 9/2013 | de Fougerolles et al. | |
| 2013/0259923 A1 | 10/2013 | Bancel et al. | |
| 2014/0147432 A1 | 5/2014 | Bancel et al. | |
| 2014/0148502 A1 | 5/2014 | Bancel et al. | |

(Continued)

FOREIGN PATENT DOCUMENTS

| EP | 2042606 A1 | 4/2009 |
|---|---|---|
| EP | 2377938 A1 | 10/2011 |

(Continued)

OTHER PUBLICATIONS

Pickard et al, J. Bacteriol., vol. 192, pp. 5746-5754. (Year: 2010).*

(Continued)

*Primary Examiner* — Jane J Zara

(74) *Attorney, Agent, or Firm* — Wolf, Greenfield & Sacks, P.C.

(57) ABSTRACT

The present disclosure provides RNA polymerase variants for high efficiency transcription.

31 Claims, 34 Drawing Sheets

Specification includes a Sequence Listing.

(56) References Cited

U.S. PATENT DOCUMENTS

| | | |
|---|---|---|
| 2014/0193482 A1 | 7/2014 | Bancel et al. |
| 2014/0206752 A1 | 7/2014 | Afeyan et al. |
| 2014/0378538 A1 | 12/2014 | Bancel |
| 2015/0051268 A1 | 2/2015 | Bancel et al. |
| 2015/0056253 A1 | 2/2015 | Bancel et al. |
| 2015/0141499 A1 | 5/2015 | Bancel et al. |
| 2015/0307542 A1 | 10/2015 | Roy et al. |
| 2015/0315541 A1 | 11/2015 | Bancel et al. |
| 2015/0368625 A1 | 12/2015 | Segall-Shapiro et al. |
| 2015/0376581 A1 | 12/2015 | Brakmann et al. |
| 2016/0024140 A1 | 1/2016 | Issa et al. |
| 2016/0024141 A1 | 1/2016 | Issa et al. |
| 2016/0032261 A1 | 2/2016 | Sobek et al. |
| 2016/0032273 A1 | 2/2016 | Shahrokh et al. |
| 2016/0038612 A1 | 2/2016 | Hoge et al. |
| 2016/0243221 A1 | 8/2016 | Hoge et al. |
| 2016/0317647 A1 | 11/2016 | Ciaramella et al. |
| 2017/0043037 A1 | 2/2017 | Kariko et al. |
| 2017/0202979 A1 | 7/2017 | Chakraborty et al. |
| 2017/0130255 A1 | 10/2017 | Wang et al. |
| 2018/0000953 A1 | 1/2018 | Almarsson et al. |
| 2018/0002393 A1 | 1/2018 | Bancel et al. |
| 2018/0073028 A1 | 3/2018 | Mirsky et al. |
| 2018/0105551 A1 | 4/2018 | Chivukula et al. |
| 2018/0237817 A1 | 8/2018 | Roos et al. |
| 2018/0237849 A1 | 8/2018 | Thompson |
| 2018/0243225 A1 | 8/2018 | Ciaramella |
| 2018/0243230 A1 | 8/2018 | Smith |
| 2018/0256628 A1 | 9/2018 | Hoge et al. |
| 2018/0271795 A1 | 9/2018 | Martini et al. |
| 2018/0271970 A1 | 9/2018 | Ciaramella et al. |
| 2018/0273977 A1 | 9/2018 | Mousavi et al. |
| 2018/0274009 A1 | 9/2018 | Marquardt et al. |
| 2018/0280496 A1 | 10/2018 | Ciaramella et al. |
| 2018/0289792 A1 | 10/2018 | Ciaramella et al. |
| 2018/0303929 A1 | 10/2018 | Ciaramella et al. |
| 2018/0311336 A1 | 11/2018 | Ciaramella et al. |

FOREIGN PATENT DOCUMENTS

| | | |
|---|---|---|
| JP | 2011-223982 A | 11/2011 |
| WO | WO 2011/128444 A2 | 10/2011 |
| WO | WO 2013/050609 A1 | 4/2013 |
| WO | WO 2013/102203 A1 | 7/2013 |
| WO | WO 2014/152027 A1 | 9/2014 |
| WO | WO 2016/164762 A1 | 10/2016 |
| WO | WO 2016/201377 A1 | 12/2016 |
| WO | WO 2017/015457 A1 | 1/2017 |
| WO | WO 2017/020026 A1 | 2/2017 |
| WO | WO 2017/053297 A1 | 3/2017 |
| WO | WO 2017/062513 A1 | 4/2017 |
| WO | WO 2017/066789 A1 | 4/2017 |
| WO | WO 2017/070601 A1 | 4/2017 |
| WO | WO 2017/070624 A1 | 4/2017 |
| WO | WO 2017/123748 A1 | 7/2017 |
| WO | WO 2017/127750 A1 | 7/2017 |
| WO | WO 2017/201333 A1 | 11/2017 |
| WO | WO 2017/201340 A1 | 11/2017 |
| WO | WO 2017/201342 A1 | 11/2017 |
| WO | WO 2017/201347 A1 | 11/2017 |
| WO | WO 2017/201349 A1 | 11/2017 |
| WO | WO 2018/053209 A1 | 3/2018 |
| WO | WO 2018/075980 A1 | 4/2018 |
| WO | WO 2018/081459 A1 | 5/2018 |
| WO | WO 2018/081788 A1 | 5/2018 |
| WO | WO 2018/089851 A1 | 5/2018 |
| WO | WO 2018/107088 A1 | 6/2018 |
| WO | WO 2018/111967 A1 | 6/2018 |
| WO | WO 2018/144082 A1 | 8/2018 |
| WO | WO 2018/144778 A1 | 8/2018 |
| WO | WO 2018/157009 A1 | 8/2018 |
| WO | WO 2018/170245 A1 | 9/2018 |
| WO | WO 2018/170256 A1 | 9/2018 |
| WO | WO 2018/170260 A1 | 9/2018 |
| WO | WO 2018/170270 A1 | 9/2018 |
| WO | WO 2018/170347 A1 | 9/2018 |
| WO | WO 2018/175783 A1 | 9/2018 |
| WO | WO 2018/187590 A2 | 10/2018 |
| WO | WO 2018/200737 A1 | 11/2018 |
| WO | WO 2018/232355 A1 | 12/2018 |
| WO | WO 2018/232357 A1 | 12/2018 |
| WO | WO 2019/005539 A1 | 1/2019 |
| WO | WO 2019/005540 A1 | 1/2019 |
| WO | WO 2019/036670 A1 | 2/2019 |
| WO | WO 2019/036682 A1 | 2/2019 |
| WO | WO 2019/036683 A1 | 2/2019 |
| WO | WO 2019/036685 A1 | 2/2019 |
| WO | WO 2019/103993 A1 | 5/2019 |
| WO | WO 2019/148101 A1 | 8/2019 |
| WO | WO 2020/006242 A1 | 1/2020 |
| WO | WO 2020/056370 A1 | 3/2020 |
| WO | WO 2020/061284 A1 | 3/2020 |
| WO | WO 2020/061295 A1 | 3/2020 |
| WO | WO 2020/061367 A1 | 3/2020 |
| WO | WO 2020/097291 A1 | 5/2020 |
| WO | WO 2020/172239 A1 | 8/2020 |
| WO | WO 2020/185811 A1 | 9/2020 |
| WO | WO 2020/190750 A1 | 9/2020 |
| WO | WO 2020/243561 A1 | 12/2020 |
| WO | WO 2021/030533 A1 | 2/2021 |
| WO | WO 2021/050864 A1 | 3/2021 |
| WO | WO 2021/055811 A1 | 3/2021 |

OTHER PUBLICATIONS

Bull et al. (J. Mol. Evol,. vol. 57, pp. 241-248 (2003)). (Year: 2003).*

International Search Report and Written Opinion for International Application No. PCT/US2020/018779 dated May 4, 2020.

Bandwar et al. The Transition to an Elongation Complex by T7 RNA Polymerase Is a Multistep Process. J. Biol. Chem. Jun. 4, 2007; 282: 22879-22886.

Bandwar et al., Sequential release of promoter contacts during transcription initiation to elongation transition. J Mol Biol. Jul. 7, 2006;360(2):466-83. Epub May 26, 2006.

Brieba et al., Scanning mutagenesis reveals roles for helix n of the bacteriophage T7 RNA polymerase thumb subdomain in transcription complex stability, pausing, and termination. J Biol Chem. Mar. 30, 2001;276(13):10306-13. Epub Dec. 21, 2000.

Gaal et al., DNA-binding determinants of the alpha subunit of RNA polymerase: novel DNA-binding domain architecture. Genes Dev. Jan. 1, 1996;10(1):16-26.

Gardner et al. Initiation, elongation, and processivity of carboxyl-terminal mutants of T7 RNA polymerase. Biochemistry. Mar. 11, 1997;36(10):2908-18.

Grosjean, H., Modification and editing of RNA: historical overview and important facts to remember. Fine-tuning of RNA functions by modification and editing. Topics Curr Gen. Jan. 2005; 12: 1-22.

Huang et al., Complete genome sequence of IME15, the first T7-like bacteriophage lytic to pan-antibiotic-resistant Stenotrophomonas maltophilia. J Virol. Dec. 2012;86(24):13839-40. doi: 10.1128/JVI.02661-12.

Ma et al. Probing conformational changes in T7 RNA polymerase during initiation and termination by using engineered disulfide linkages. Proc Natl Acad Sci U S A. Dec. 6, 2005;102(49):17612-7. Epub Nov. 21, 2005.

Tang et al. Relaxed rotational and scrunching changes in P266L mutant of T7 RNA polymerase reduce short abortive RNAs while delaying transition into elongation. PLoS One. Mar. 20, 2014;9(3):e91859. doi: 10.1371/journal.pone.0091859. eCollection 2014.

* cited by examiner (GGG trinuc)

(m6A trinuc)

(e6A trinuc)

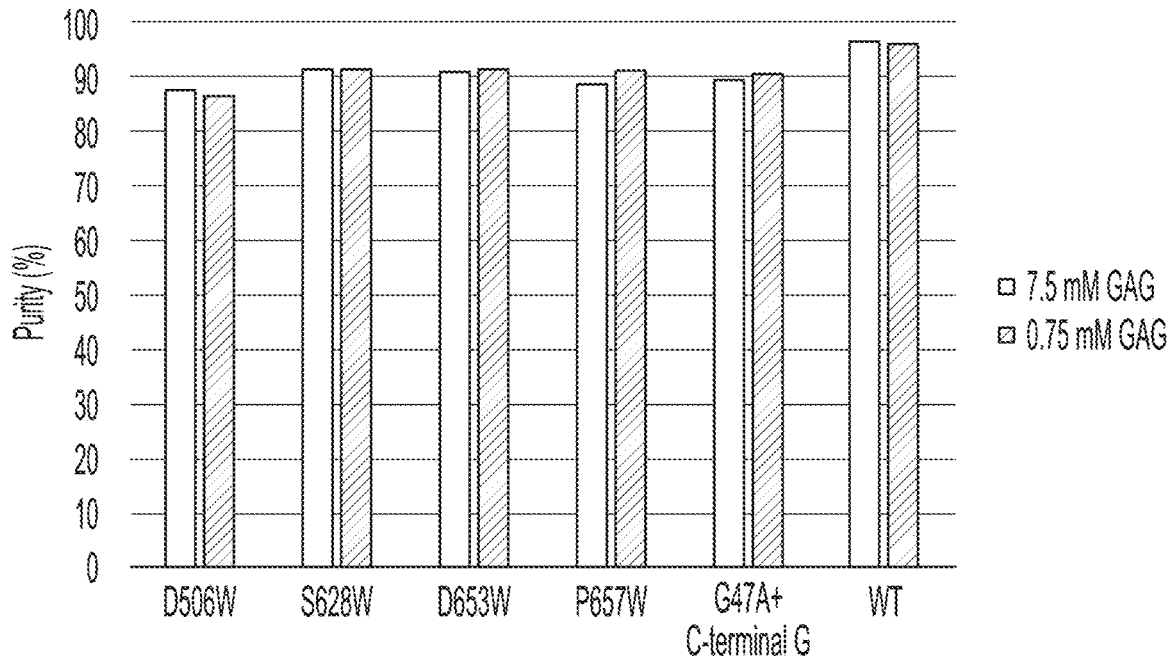
FIG. 3C Purity by DBAA method
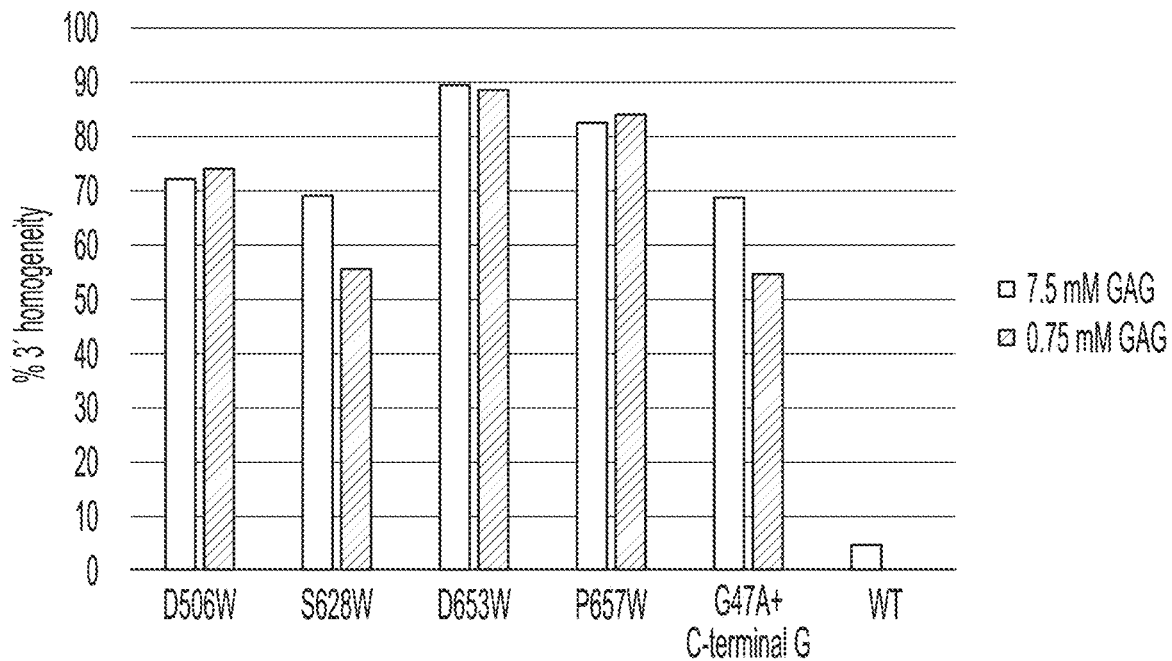
FIG. 3D 3' homogeneity (GGAG tetranuc)

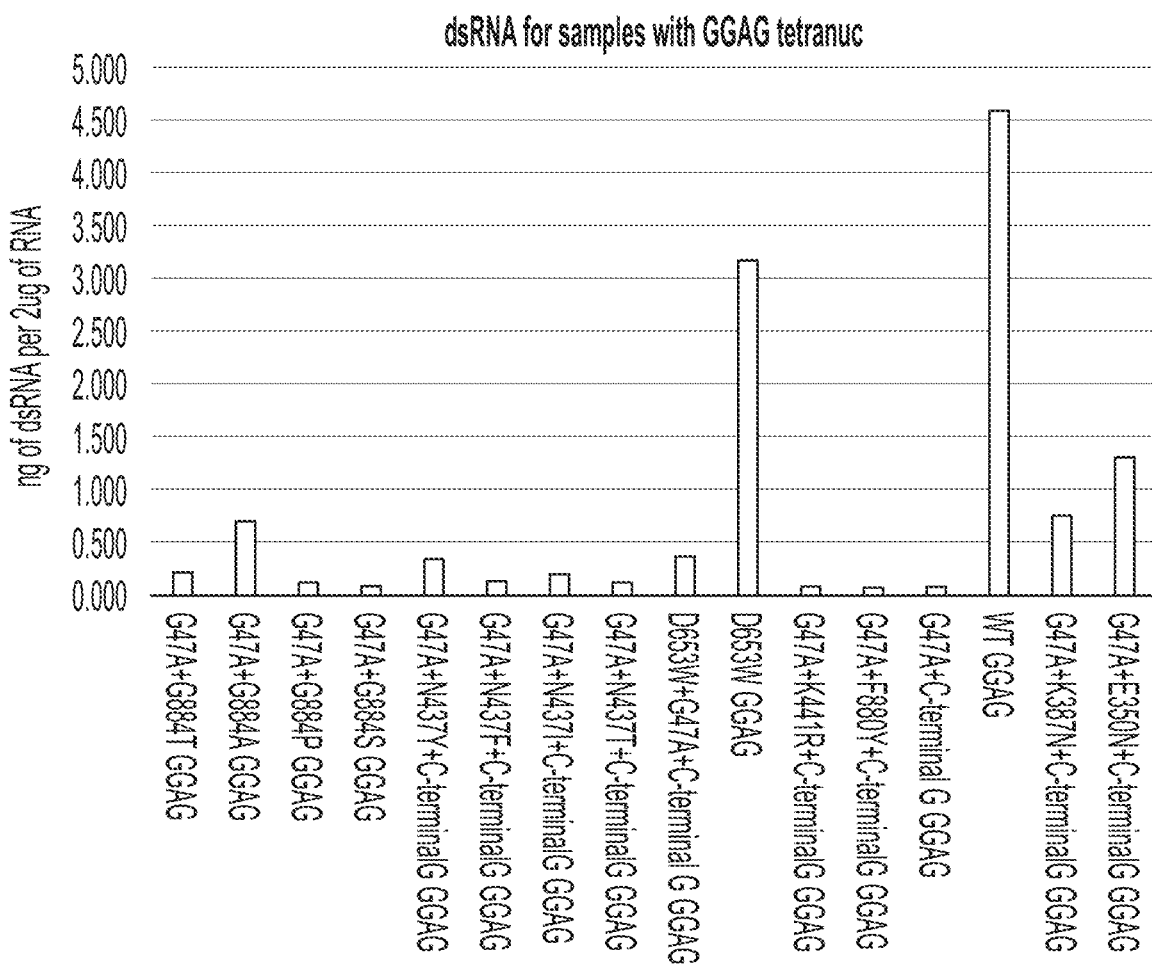

US 11,485,960 B2

RNA POLYMERASE VARIANTS FOR CO-TRANSCRIPTIONAL CAPPING

RELATED APPLICATIONS

This application is a continuation of international application number PCT/US2020/018779, filed Feb. 19, 2020, which claims the benefit under 35 U.S.C. § 119(e) of U.S. provisional application No. 62/808,182, filed Feb. 20, 2019, U.S. provisional application No. 62/832,314, filed Apr. 11, 2019, and U.S. provisional application No. 62/885,928, filed Aug. 13, 2019, each of which is incorporated by reference herein in its entirety.

BACKGROUND

In vitro transcription (IVT) uses bacteriophage DNA-dependent ribonucleic acid (RNA) polymerases (e.g., SP6, T3 and T7) to synthesize template-directed mRNA transcripts. Problems in the IVT reaction can result in complete failure (e.g., no transcript generated) or in transcripts that are the incorrect size (e.g., shorter or longer than expected). Specific problems associated with IVT reactions include, for example, abortive (truncated) transcripts, run-on transcripts, polyA tail variants/3' heterogeneity, mutated transcripts, and/or double-stranded contaminants produced during the reactions.

RNA polymerases exhibit three phases of transcription—initiation, elongation and termination. During the initiation phase, the RNA polymerase binds to a specific promoter DNA sequence, opens the DNA duplex and feeds the template strand into the active site. T7 RNA polymerase, for example, forms a structure referred to as initiation complex, which includes a six-helix bundle sub-domain (the promoter binding domain) that interacts with the promoter to initiate DNA duplex melting. While bound to the promoter, the polymerase produces many short (truncated) transcripts from 2-12 nucleotides (nt) in length, a process often referred to as abortive synthesis/initiation. The truncated RNA transcripts cannot be converted to full-length transcripts by RNA polymerase and become by-products that accumulate during transcription. After the transition to the elongation phase and release of the promoter, the polymerase proceeds down the DNA template producing a full-length RNA transcript.

During the elongation phase, RNA polymerase often continues to transcribe DNA beyond the point at which termination should be initiated, generating longer than expected RNA transcripts ("run-on transcripts"). T7 RNA polymerase, for example, adds nucleotides to the end of a transcript before 'falling off' the template. Studies suggest that more than 70% of transcripts generated by T7 RNA polymerase in vitro may be run-on transcripts. In some cases, these aberrant RNA products are twice the length of the encoded sequence. Because run-on transcription is stochastic, there is often great 3' heterogeneity among products in a given IVT reaction. This 3' heterogeneity is problematic for downstream applications, such as ligation reactions, which are dependent on RNA transcripts of a defined length and/or nucleotide composition.

SUMMARY

Provided herein, in some aspects, are RNA polymerase variants and in vitro transcription methods using these variants. The RNA polymerase variants of the present disclosure have been shown, in some embodiments, that when used in an in vitro transcription reaction, for example, the polymerase variants, increase transcription efficiency, increase co-transcriptional capping efficiency, increase yield of RNA and improve 3' homogeneity of RNA at half the concentration of a cap analog, improve fidelity of transcription, and/or lower the amount of dsRNA contamination.

Some aspects of the present disclosure provide a ribonucleic acid (RNA) polymerase variant comprising a RNA polymerase that comprises at least one amino acid substitution.

In some embodiments, the RNA polymerase variant comprises a RNA polymerase that comprises at least one amino acid substitution at a position selected from the group consisting of E350, D351, K387, N437, K441, D506, R632, D653, S628, P657, F880, and G884 relative to a RNA polymerase comprising the amino acid sequence of SEQ ID NO: 44.

In some embodiments, the RNA polymerase variant comprises a RNA polymerase that comprises amino acid substitutions at two of the positions selected from the group consisting of E350, D351, K387, and D653, relative to a wild-type RNA polymerase comprising the amino acid sequence of SEQ ID NO: 1. In some embodiments, the two amino acid substiutions are E350 and D351. In some embodiments, the two amino acid substiutions are E350 and K387. In some embodiments, the two amino acid substiutions are K387 and D653.

In some embodiments, the RNA polymerase comprises an amino acid substitution at E350. In some embodiments, the RNA polymerase comprises an amino acid substitution at D351. In some embodiments, the RNA polymerase comprises an amino acid substitution at K387. In some embodiments, the RNA polymerase comprises an amino acid substitution at N437. In some embodiments, the RNA polymerase comprises an amino acid substitution at K441. In some embodiments, the RNA polymerase comprises an amino acid substitution at D506. In some embodiments, the RNA polymerase comprises an amino acid substitution at R632. In some embodiments, the RNA polymerase comprises an amino acid substitution at D653. In some embodiments, the RNA polymerase comprises an amino acid substitution at S628. In some embodiments, the RNA polymerase comprises an amino acid substitution at P657. In some embodiments, the RNA polymerase comprises an amino acid substitution at F880. In some embodiments, the RNA polymerase comprises an amino acid substitution at G884.

In some embodiments, the RNA polymerase comprises at least two, at least three, at least four, or at least five amino acid substitutions at positions selected from the group consisting of E350, D351, K387, N437, K441, D506, R632, D653, S628, P657, F880, and G884.

In some embodiments, the RNA polymerase comprises amino acid substitutions at positions selected from the group consisting of: E350 and D351; E350 and K387; E350 and N437; E350 and K441; E350 and D506; E350 and R632; E350 and D653; E350 and S628; E350 and P657; E350 and F880; E350 and G884; D351 and K387, D351 and N437; D351 and K441; D351 and D506; D351 and R632; D351 and D653; D351 and S628; D351 and P657; D351 and F880;

D351 and G884; K387 and N437; K387 and K441; K387 and D506; K387 and R632; K387 and D653; K387 and S628; K387 and P657; K387 and F880; and K387 and G884; N437 and K441; N437 and D506; N437 and R632; N437 and D653; N437 and S628; N437 and P657; N437 and F880; N437 and G884; K441 and D506; K441 and R632; K441 and D653; K441 and S628; K441 and P657; K441 and F880; K441 and G884; D506 and R632; D506 and D653; D506 and S628; D506 and P657; D506 and F880; D506 and G884; R632 and D653; R632 and S628; R632 and P657; R632 and F880; R632 and G884; D653 and S628; D653 and P657; D653 and F880; D653 and G884; S628 and P657; S628 and F880; S628 and G884; P657 and F880; P657 and G884; and F880 and G884.

In some embodiments, the RNA polymerase comprises acid substitutions at positions selected from the group consisting of: K387, D653, and G884; E350, D351, and K387; and D653, P657, and R632.

In some embodiments, the amino acid substitution at E350 is selected from the group consisting of E350A, E350K, E350N, and E350W, optionally wherein the amino acid substitution at E350 is E350N.

In some embodiments, the amino acid substitution at D351 is D351V.

In some embodiments, the amino acid substitution at K387 is selected from the group consisting of K387H, K387N, and K387S, optionally wherein the amino acid substitution at K387 is K387N.

In some embodiments, the amino acid substitution at N437 is selected from the group consisting of N437F, N437I, N437T, and N437Y, optionally wherein the amino acid substitution at N437 is N437F.

In some embodiments, the amino acid substitution at K441 is K441R.

In some embodiments, the amino acid substitution at D506 is selected from the group consisting of D506F, D506L, D506R, D506W, and D506Y.

In some embodiments, the amino acid substitution at R632 is R632K or R632T.

In some embodiments, the amino acid substitution at D653 is selected from the group consisting of D653A, D653F, D653G, D653H, D653I, D653K, D653L, D653M, D653N, D653P, D653Q, D653R, D653S, D653T, D653V, D653W, and D653Y, optionally wherein the amino acid substitution at D653 is D653W.

In some embodiments, the amino acid substitution at S628 is S628W.

In some embodiments, the amino acid substitution at P657 is selected from the group consisting of P657A, P657R, and P657W.

In some embodiments, the amino acid substitution at F880 is F880Y.

In some embodiments, the amino acid substitution at G884 is selected from the group consisting of G884A, G884S, G884T, and G884P.

In some embodiments, the RNA polymerase comprises any one amino acid sequence as described herein.

Other aspects of the present disclosure provide a method comprising producing a mRNA in an in vitro transcription reaction that comprises a DNA template, nucleoside triphosphates, any one of the RNA polymerase variants as described herein, and optionally a cap analog. In some embodiments, the reaction comprises the cap analog. In some embodiments, the reaction comprises a concentration of the cap analog that is at least 5-fold lower than a concentration of the cap analog required to produce an equivalent amount of mRNA using a T7 RNA polymerase that comprises the amino acid sequence of SEQ ID NO: 44.

In some embodiments, greater than 80% of the mRNA produced includes a functional cap, greater the 50% of the mRNA produced is homogeneous at the 3' end, and/or the reaction comprises less than 5 ng dsRNA per 25 μg of mRNA produced.

In some embodiments, the cap analog and nucleoside triphosphates are present in the reaction at equimolar concentrations, or a molar ratio of cap analog to nucleoside triphosphates in the reaction is greater than 1:1. In some embodiments, the cap analog is a dinucleotide cap, a trinucleotide cap, or a tetranucleotide cap. In some embodiments, the cap analog is a trinucleotide cap analog comprising a GAG sequence In some embodiments, the GAG cap analog comprises a compound selected from:

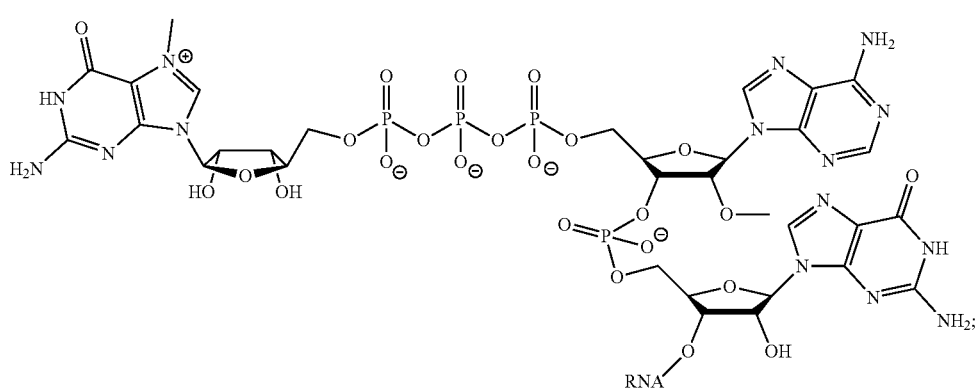

(i)

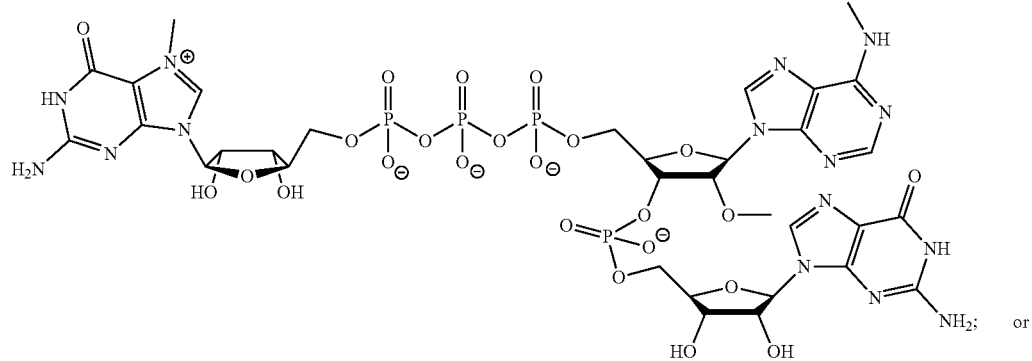
(ii)
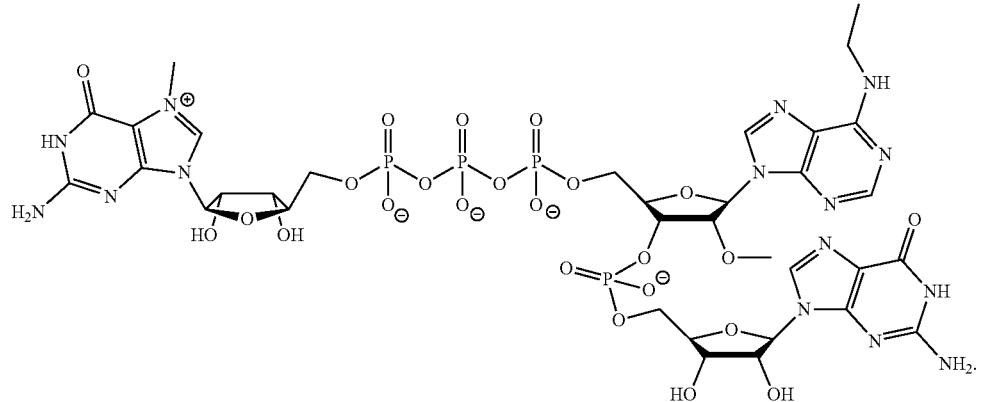
(iii)
In some embodiments, the cap analog is a tetranucleotide cap analog comprising a GGAG sequence.
In some embodiments, the tetranucleotide cap analog comprises a compound selected from:
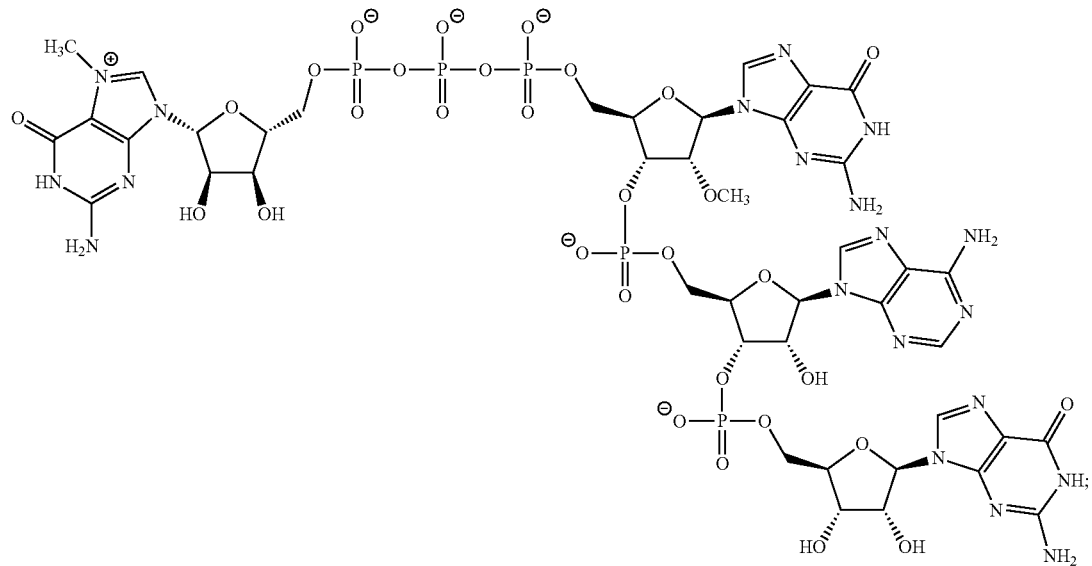
(iv)

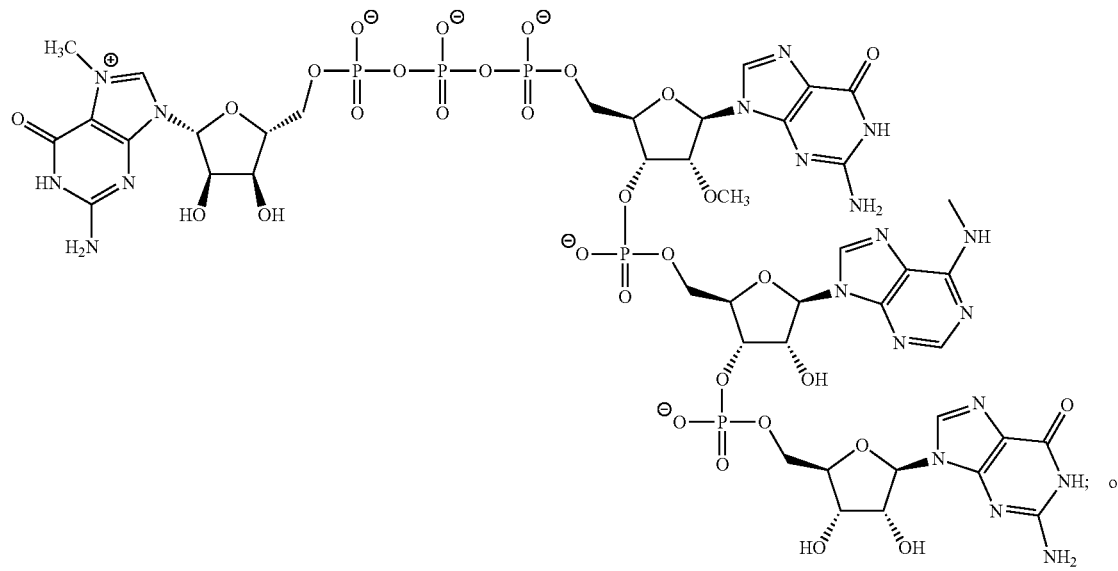

(v)

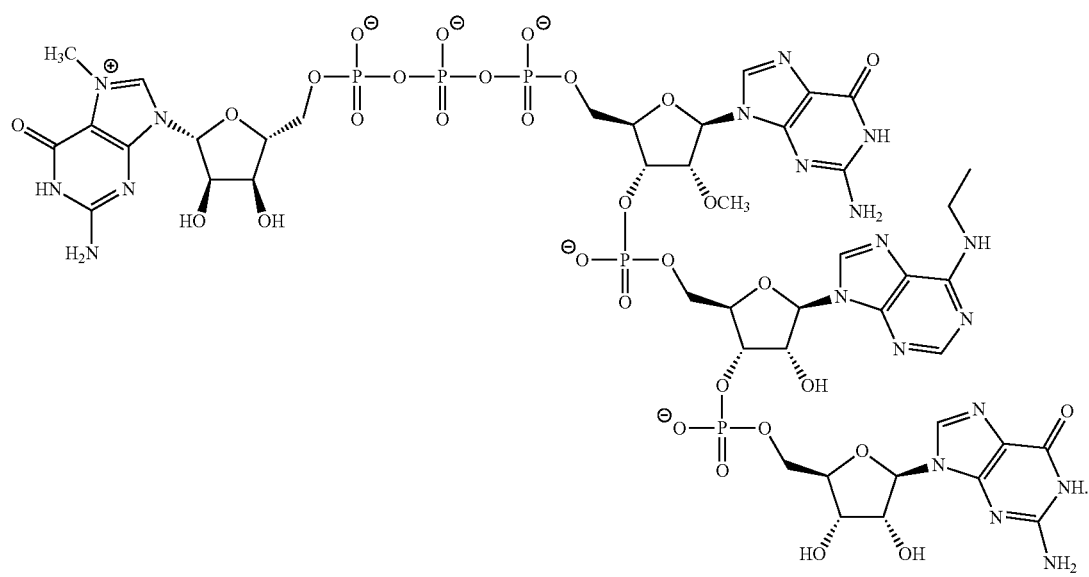

(vi)

In some embodiments, the polynucleotide template includes a 2'-deoxythymidine residue or a 2'-deoxycytidine residue at template position+1.

Other aspects of the present disclosure provide a composition or kit comprising any one of the RNA polymerase variants as described herein and an IVT reaction component, optionally selected from the group consisting of a polynucleotide template, nucleoside triphosphates, and a cap analog.

Other aspects of the present disclosure provide a nucleic acid encoding any one of the RNA polymerase variants as described herein.

BRIEF DESCRIPTION OF THE DRAWINGS

FIGS. 3A-3E show graphs depicting the functional characteristics of transcribed RNA products resulting from in vitro transcription (IVT) reactions involving mutant variants of a control T7 RNA polymerase variant (G47A+C-terminal G) in the presence of varying levels of GAG cap analog.

Figure 3A:
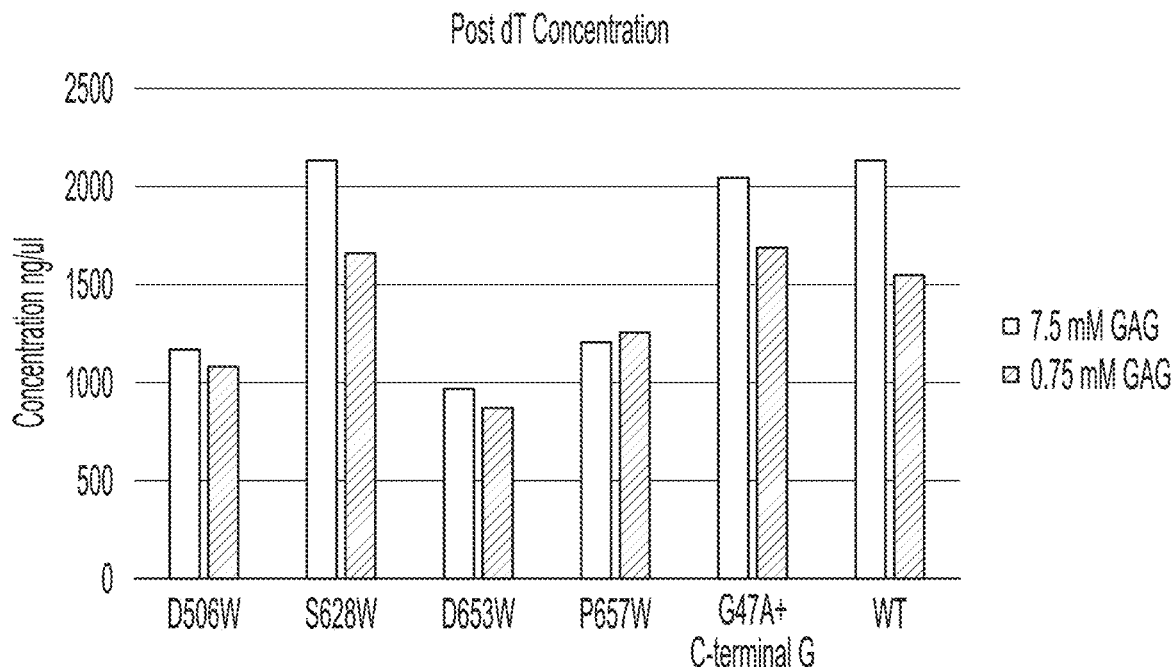
Figure 3B:
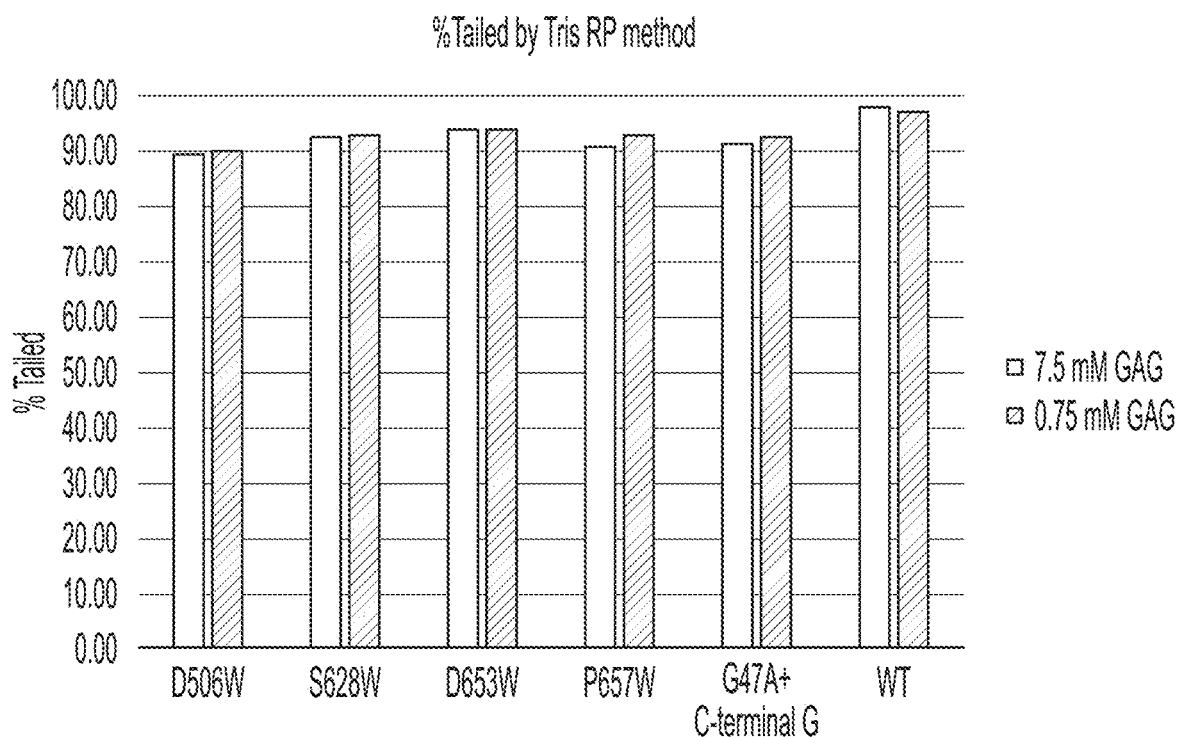
Figure 3E:
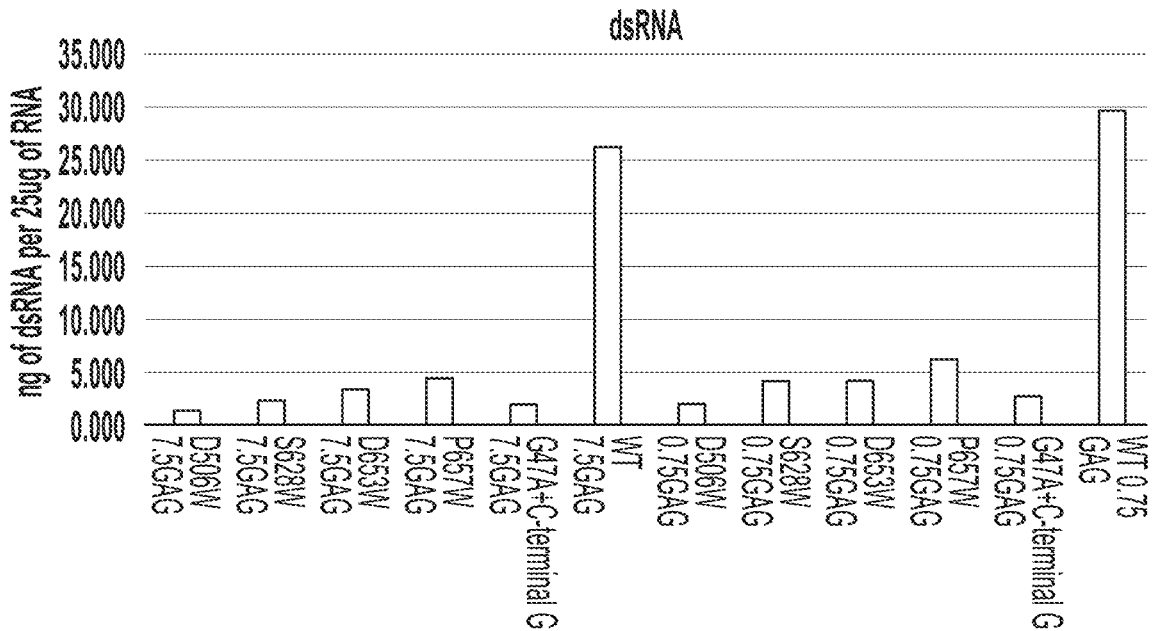

Following an oligo dT purification, transcribed RNA products were analyzed for concentration (FIG. 3A), percent tailed (i.e., percent of RNA comprising a polyA tail) according to a Tris RP (reverse-phase) method (FIG. 3B), purity according to a DBAA (dibutylammonium acetate) HPLC method (FIG. 3C), 3' homogeneity (FIG. 3D), and amount of dsRNA (FIG. 3E).

FIGS. 4A-4E show graphs depicting the percent capped RNA resulting from in vitro transcription (IVT) reactions involving mutant variants of a control T7 RNA polymerase variant (G47A+C-terminal G) in the presence of varying levels of GAG cap.

FIGS. 5A-5D show graphs depicting the percent capped RNA resulting from IVT reactions involving mutant variants of a control T7 RNA polymerase variant (G47A+C-terminal G) in the presence of varying levels of e6A trinucleotide (trinuc).

FIGS. 6A-6D show graphs depicting the percent capped RNA resulting from IVT reactions involving mutant variants of a control T7 RNA polymerase variant (G47A+C-terminal G) in the presence of varying levels of m6A trinuc.

Figure 7:
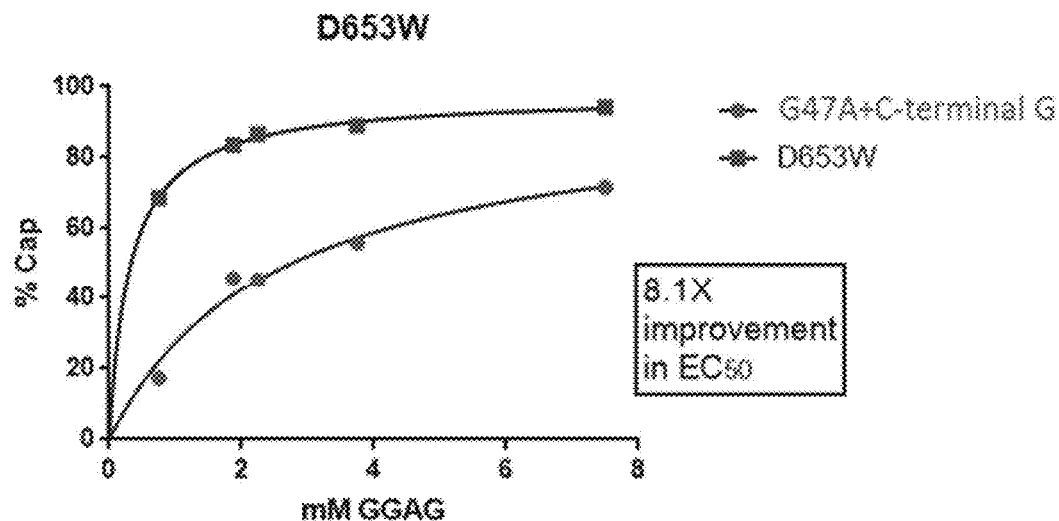
Figure 7:
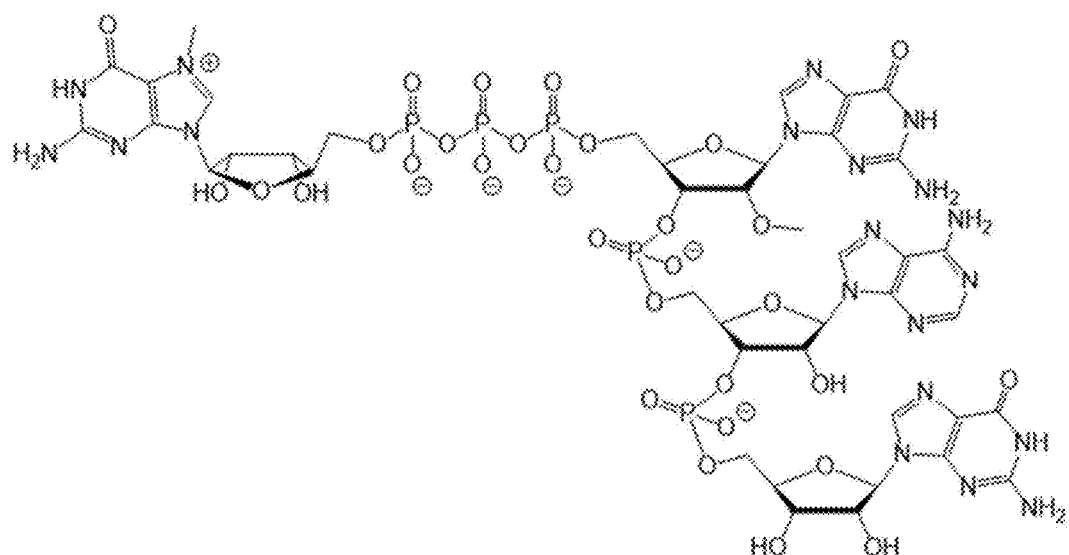
Figure 8A:
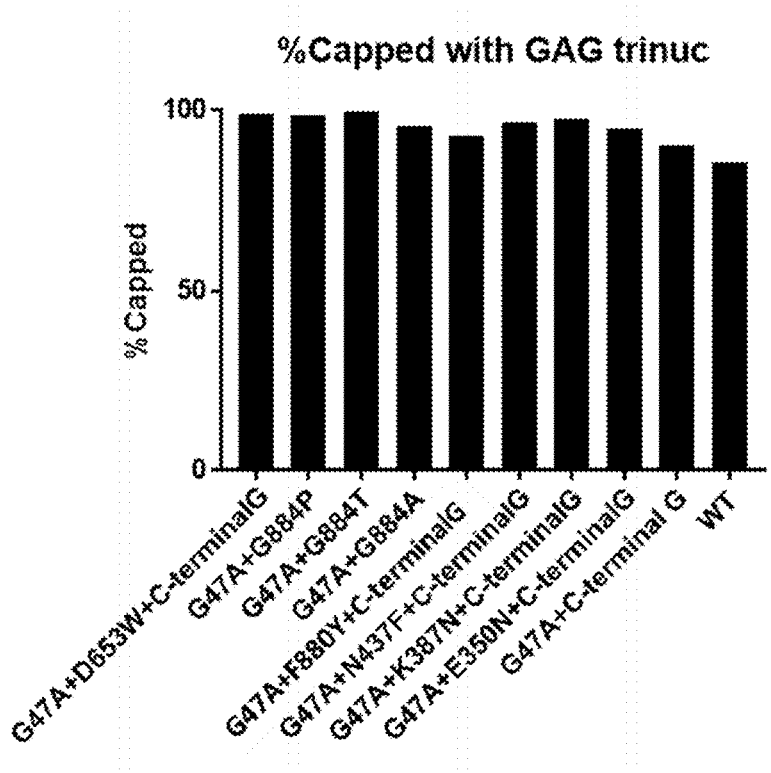
Figure 8B:
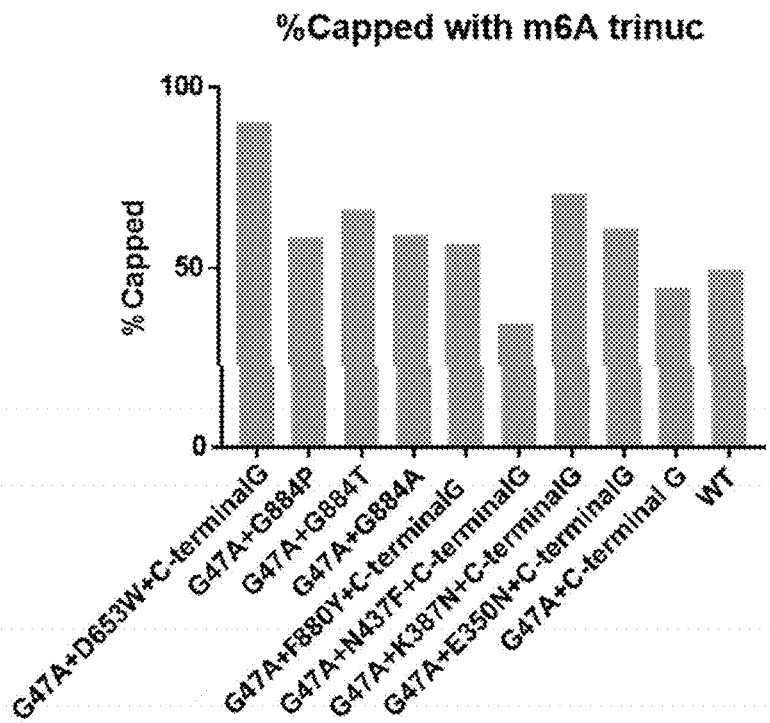
Figure 8C:
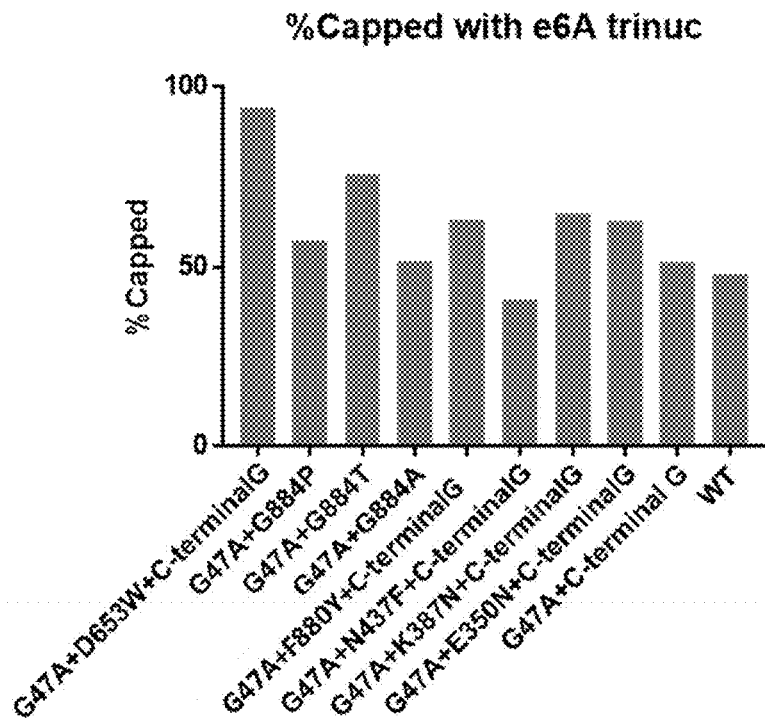
Figure 8D:
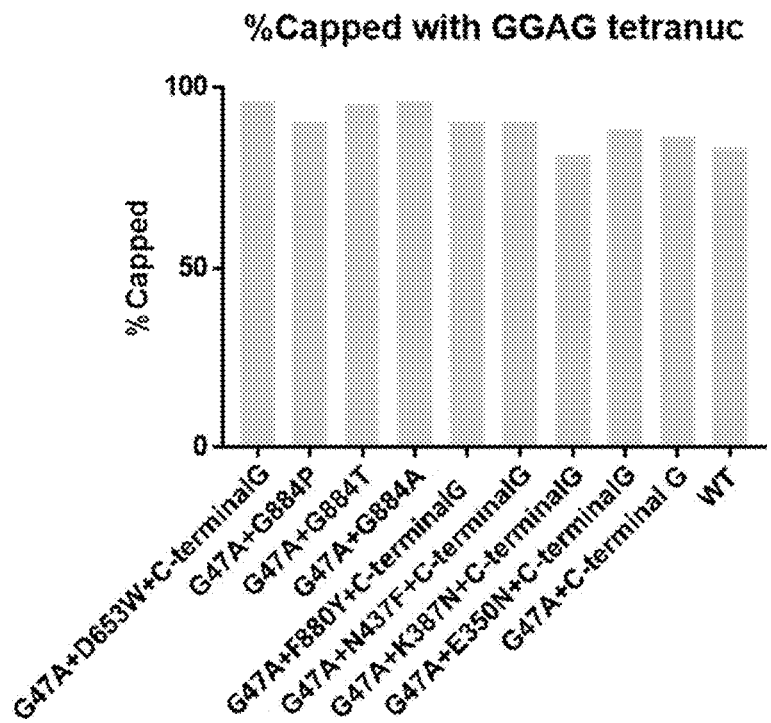
Figure 8E:
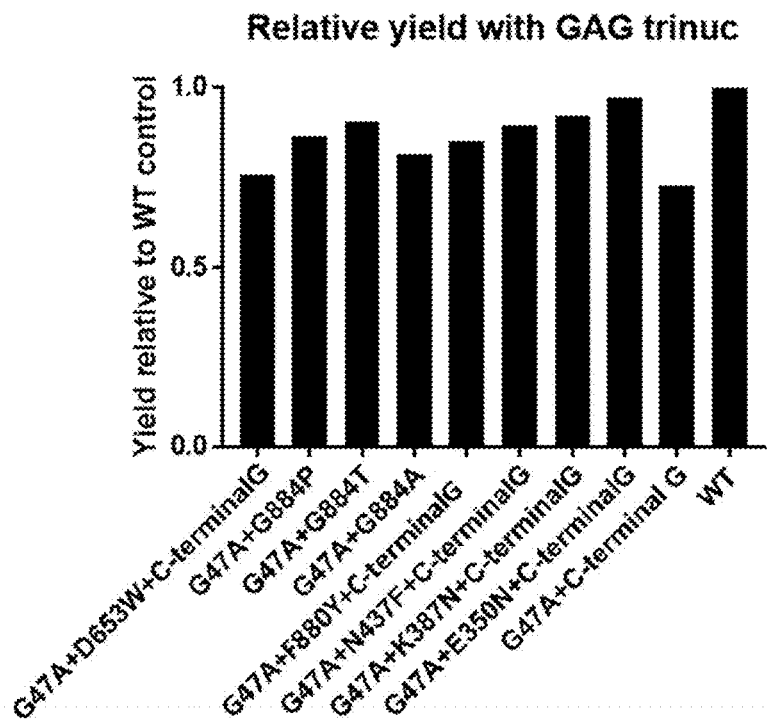
Figure 8F:
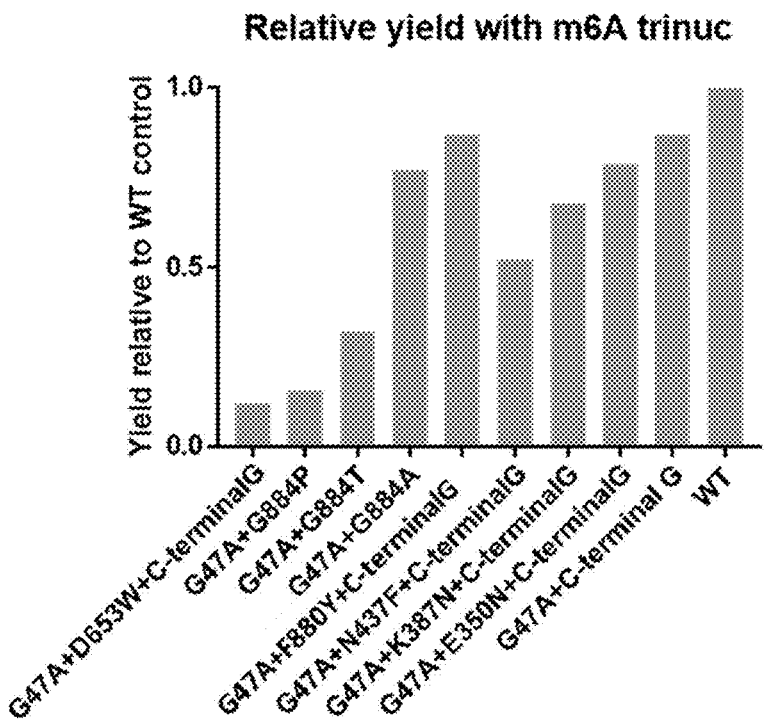
Figure 8G:
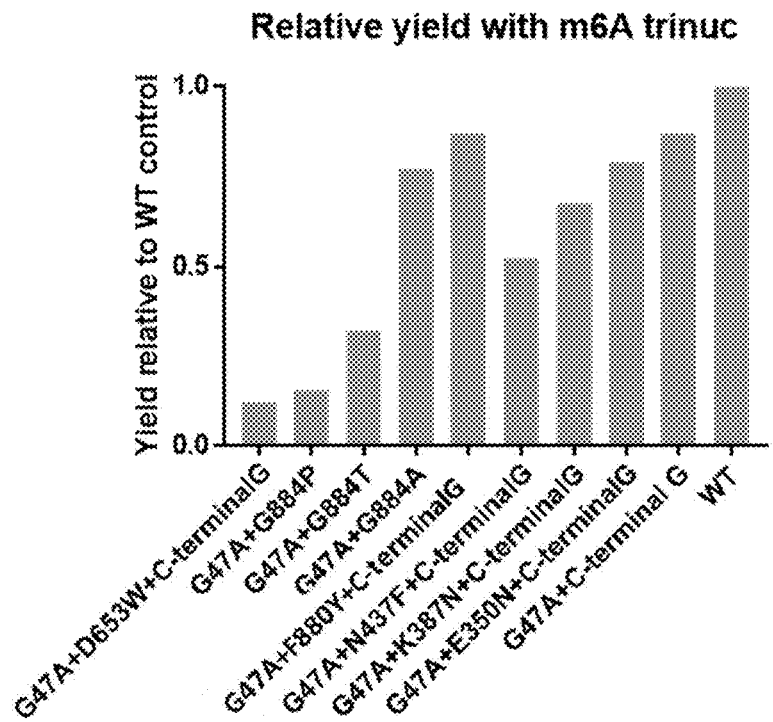
Figure 8H:
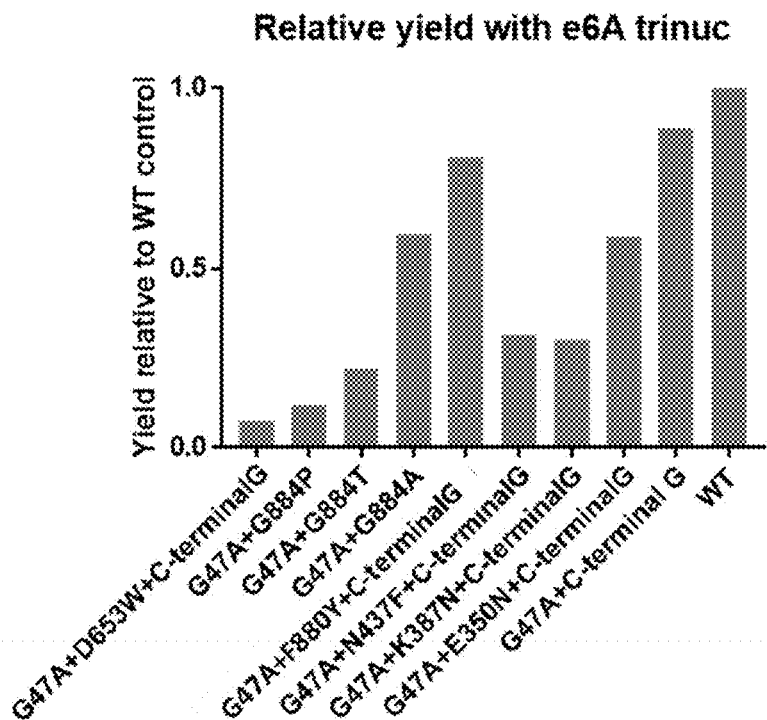
Figure 8I:
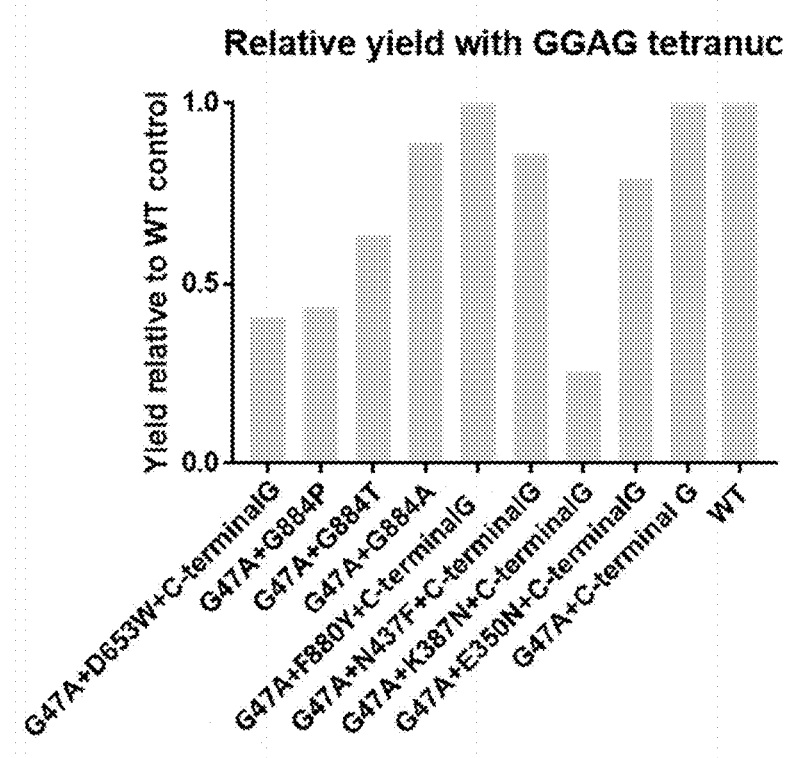

FIG. 7 shows a graph depicting the percent capped RNA resulting from IVT reactions involving mutant variants of a control T7 RNA polymerase variant (G47A+C-terminal G) in the presence of varying levels of a GGAG tetranucleotide (tetranuc). The structure of the GGAG tetranucleotide is provided in the lower half of FIG. 7.

FIGS. 8A-8I show graphs depicting the percent capped RNA (FIGS. 8A-8D) and relative RNA yield (FIG. 8E-8I) resulting from IVT reactions involving mutant variants of a control T7 RNA polymerase variant (G47A+C-terminal G) in the presence of a GAG trinuc, m6A trinuc, e6A trinuc, or tetranuc. FIGS. 8E-8I are normalized to an IVT reaction involving WT T7 RNA polymerase.

Figure 9A:
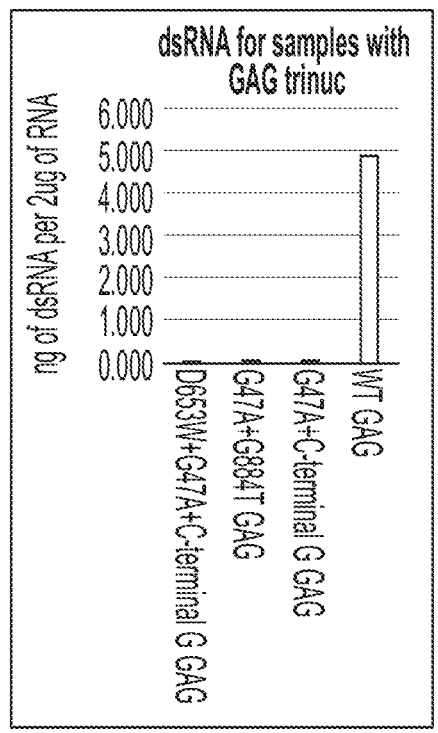
Figure 9B:
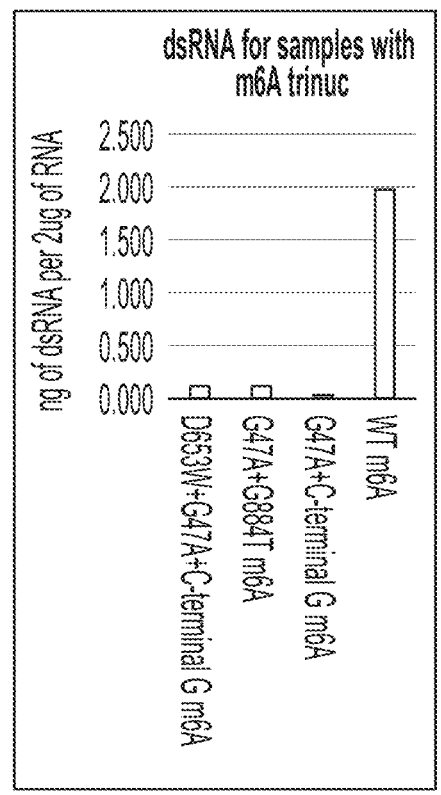
Figure 9C:
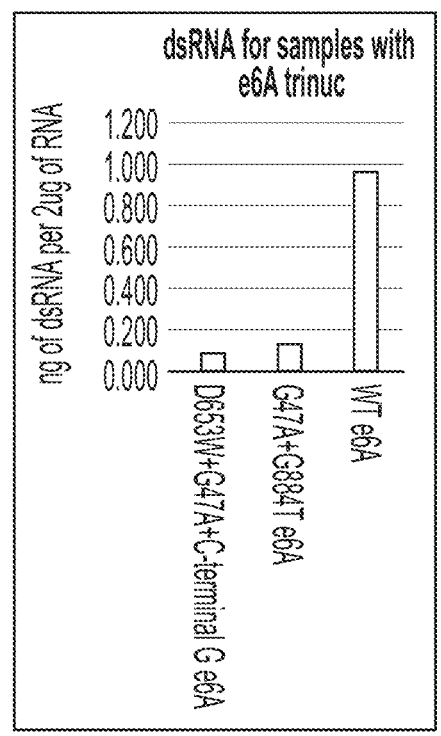

FIGS. 9A-9D show graphs depicting dsRNA content resulting from IVT reactions involving mutant variants of a control T7 RNA polymerase in the presence of GAG trinuc (FIG. 9A), m6A trinuc (FIG. 9B), e6A trinuc (FIG. 9C), and GGAG tetranuc (FIG. 9D).

FIGS. 10A-10D show graphs depicting the 3' homogeneity (FIG. 10A), percent capped RNA (FIG. 10B), percent full-length RNA product (FIG. 10C), and crude yield over time (FIG. 10D) resulting from IVT reactions involving mutant variants of a control T7 RNA polymerase in the presence of a GAG trinuc.

Figure 11:
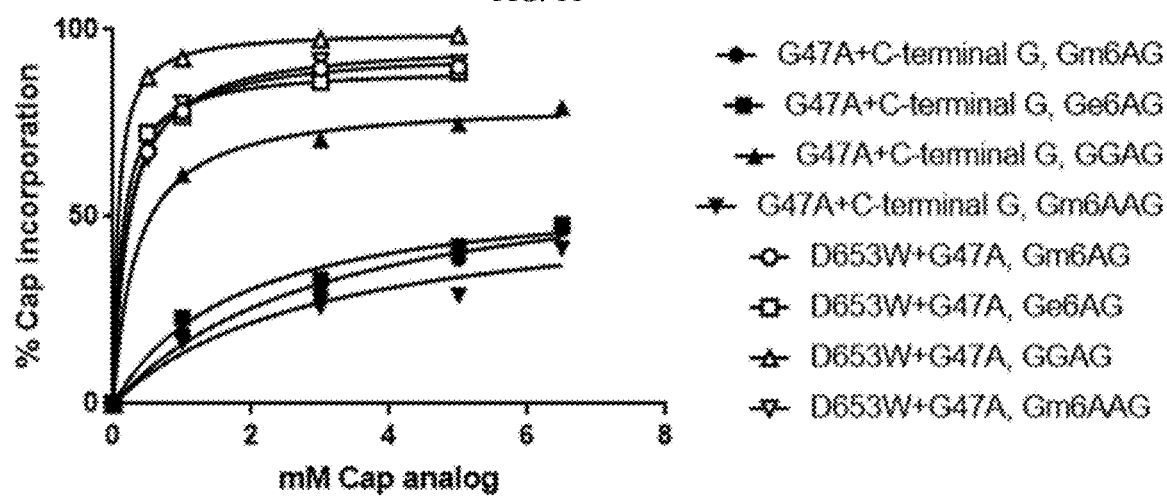

FIG. 11 shows a graph depicting the percent capped RNA resulting from IVT reactions involving the D653W+G47A RNA polymerase variant in the presence of varying concentrations of cap analogs.

Figure 12:
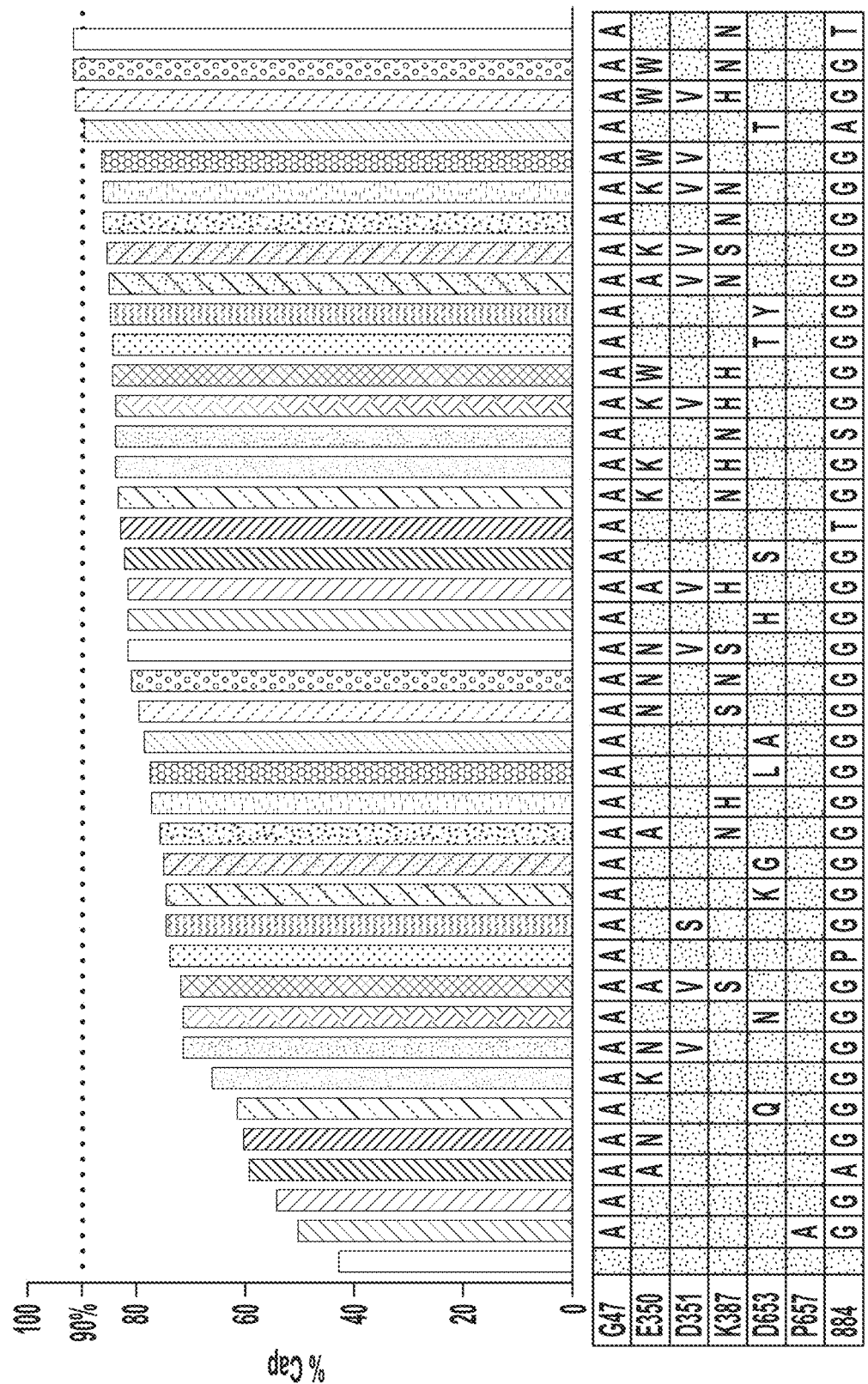

FIG. 12 shows a graph depicting the capping efficiency of multi-substitution RNA polymerase variants in the presence of a GAG trinucleotide cap analog.

Figure 13A:
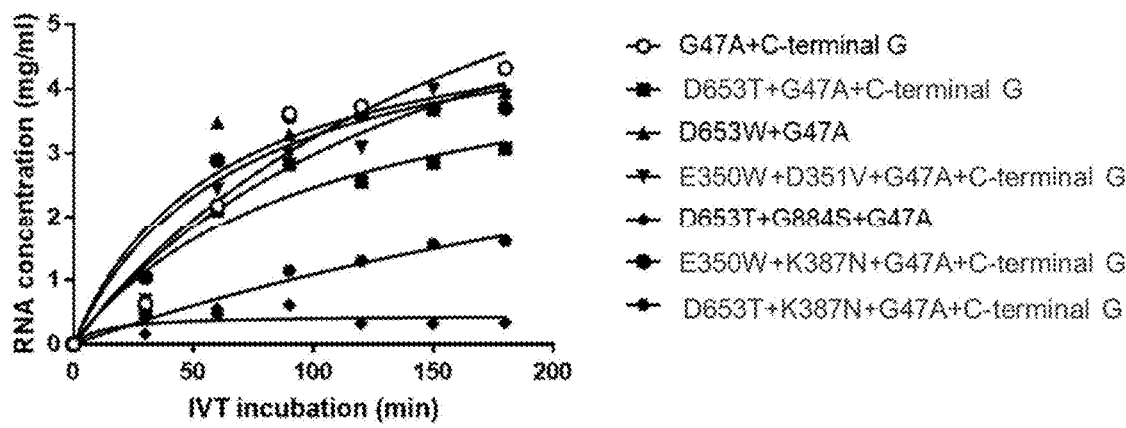
Figure 13B:
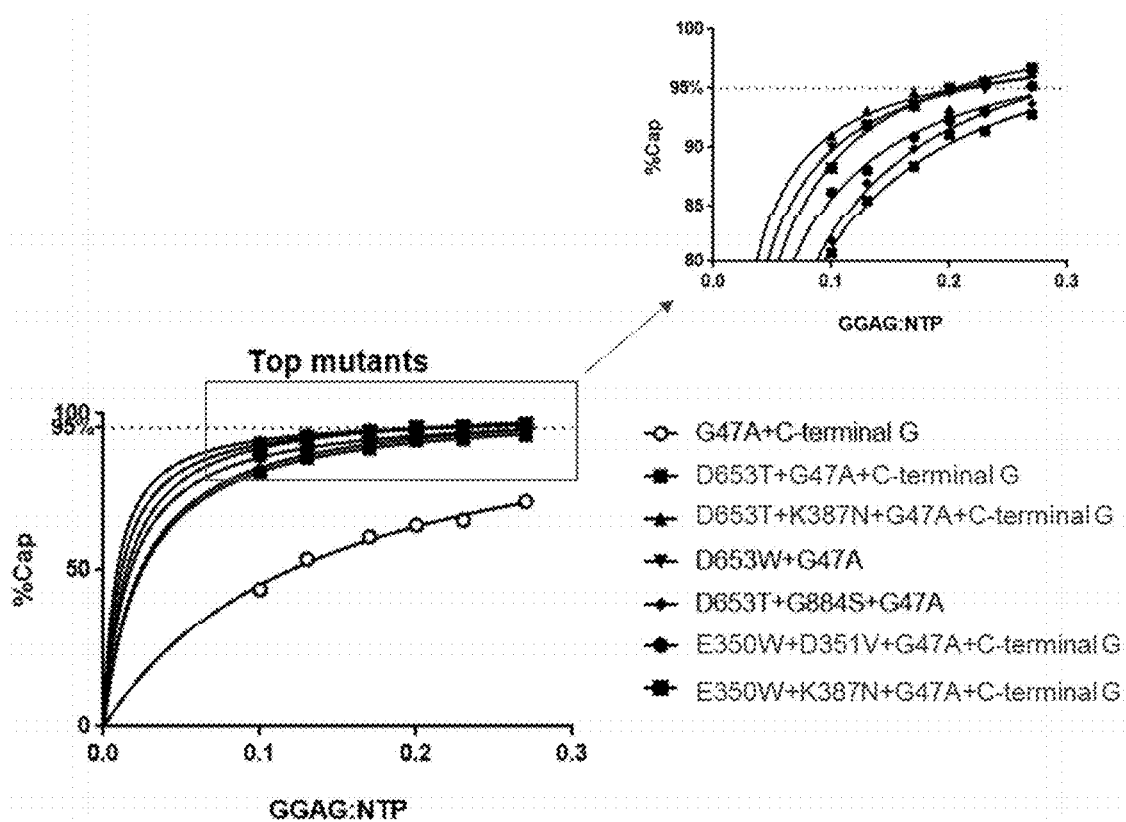

FIGS. 13A-13B show graphs depicting the relative RNA yield (FIG. 13A) and percent capped RNA (FIG. 13B) resulting from IVT reactions involving multi-substitution RNA polymerase variants in the presence of GGAG tetranucleotide cap analog.

Figure 14A:
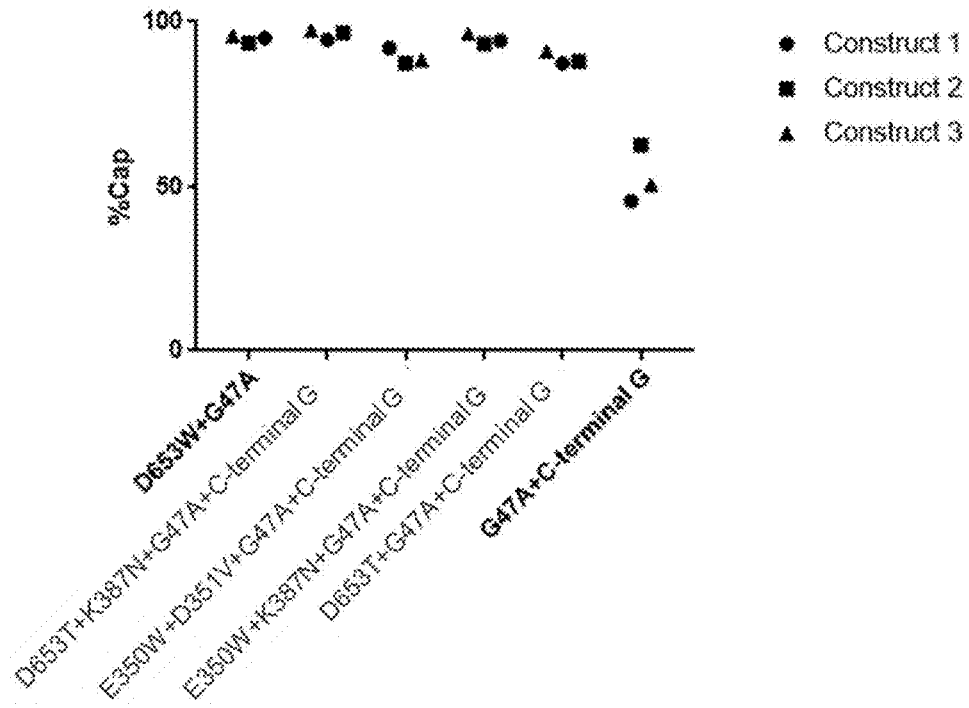
Figure 14B:
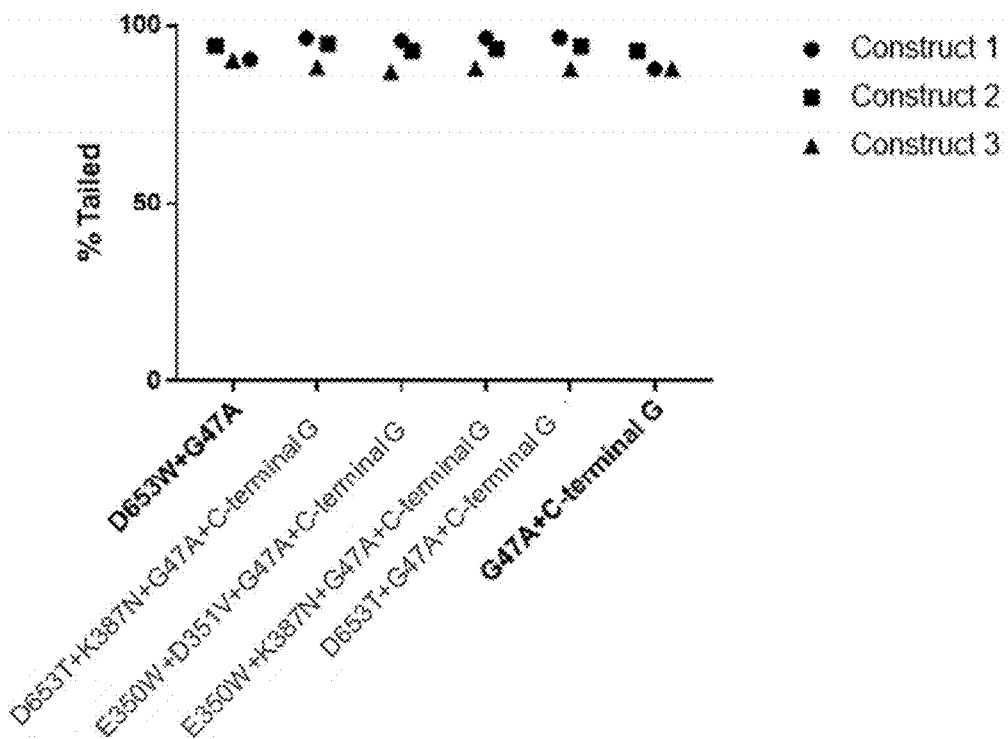
Figure 14C:
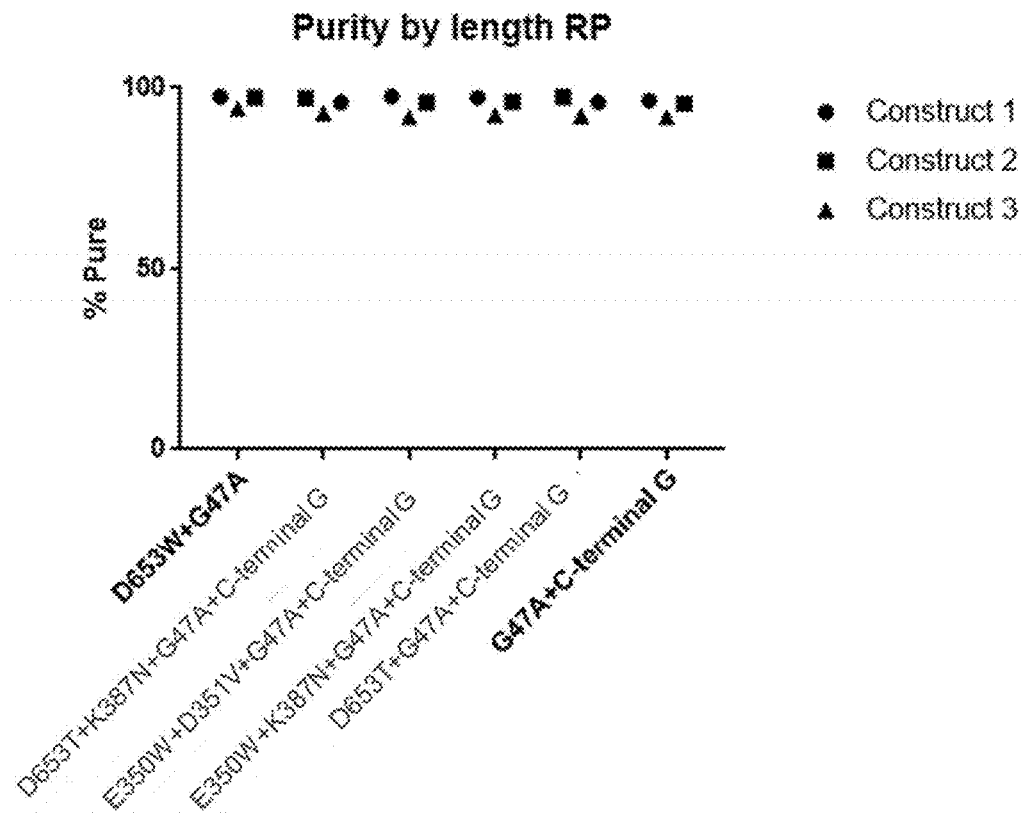
Figure 14D:
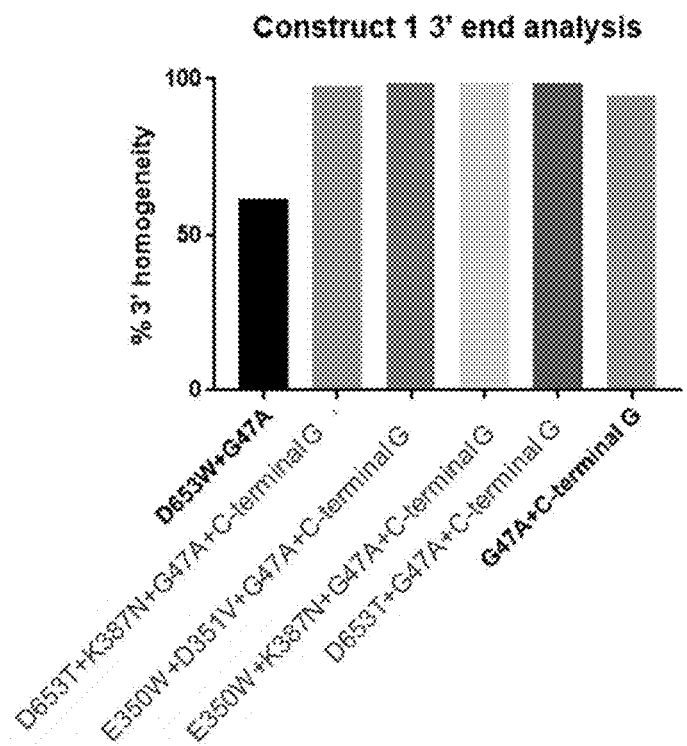
Figure 14E:
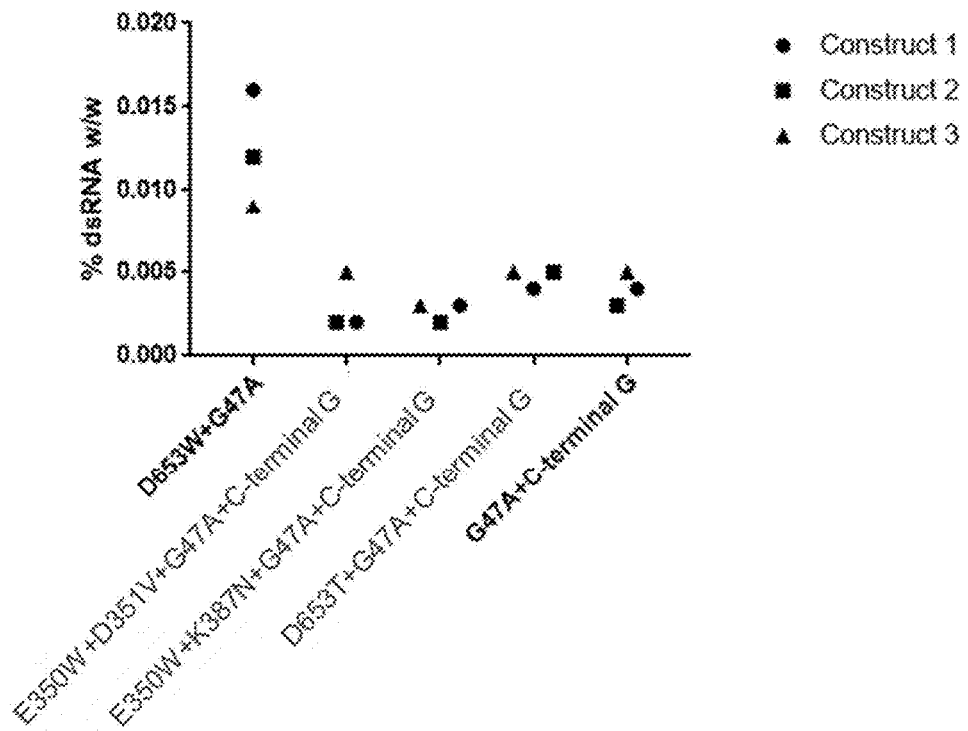

FIGS. 14A-14E show graphs depicting the functional characteristics of transcribed RNA products resulting from IVT reactions involving multi-substitution RNA polymerase variants and three different DNA templates in the presence of GGAG tetranucleotide cap analog. Following an oligo dT purification, transcribed RNA products were analyzed for percent capped RNA (FIG. 14A), percent tailed RNA (i.e., percent of RNA comprising a polyA tail) according to a Tris RP (reverse-phase) method (FIG. 14B), purity according to a RP HPLC method (FIG. 14C), 3' homogeneity (FIG. 14D), and amount of dsRNA (FIG. 14E).

Figure 15A:
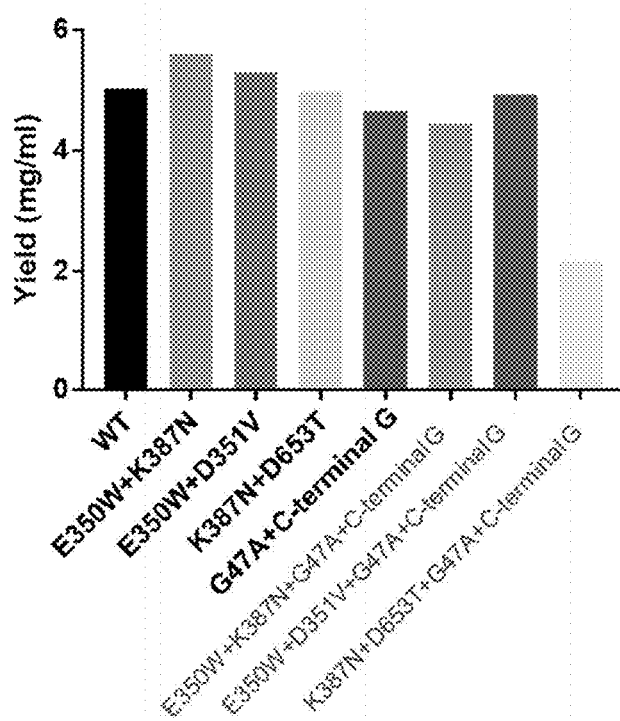
Figure 15B:
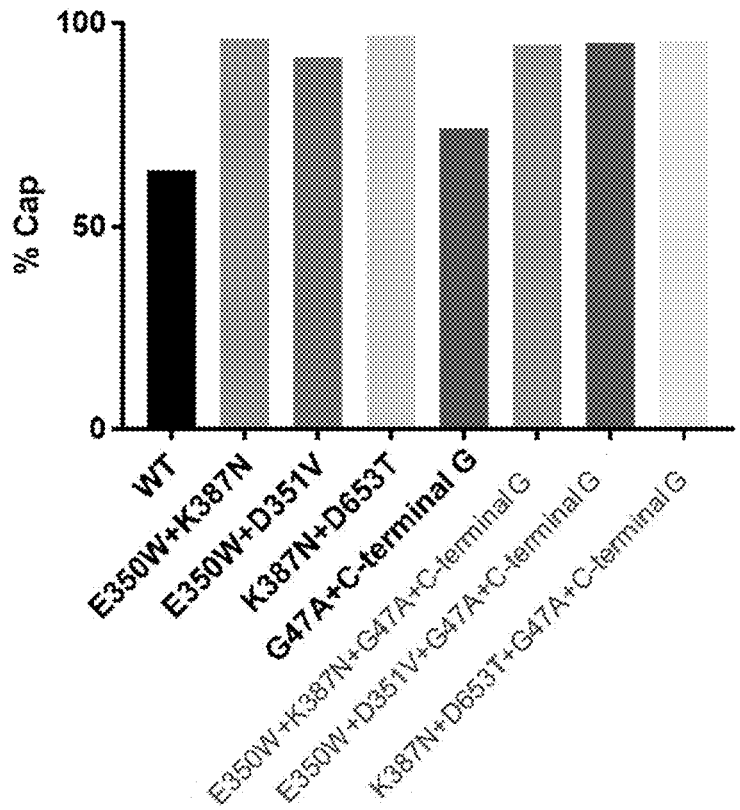
Figure 15C:
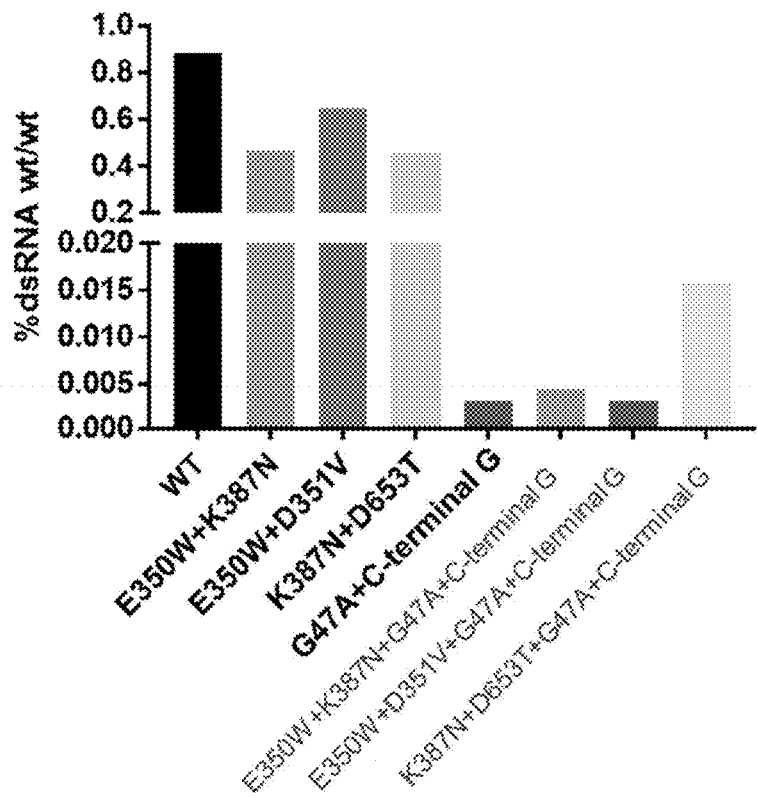
Figure 15D:
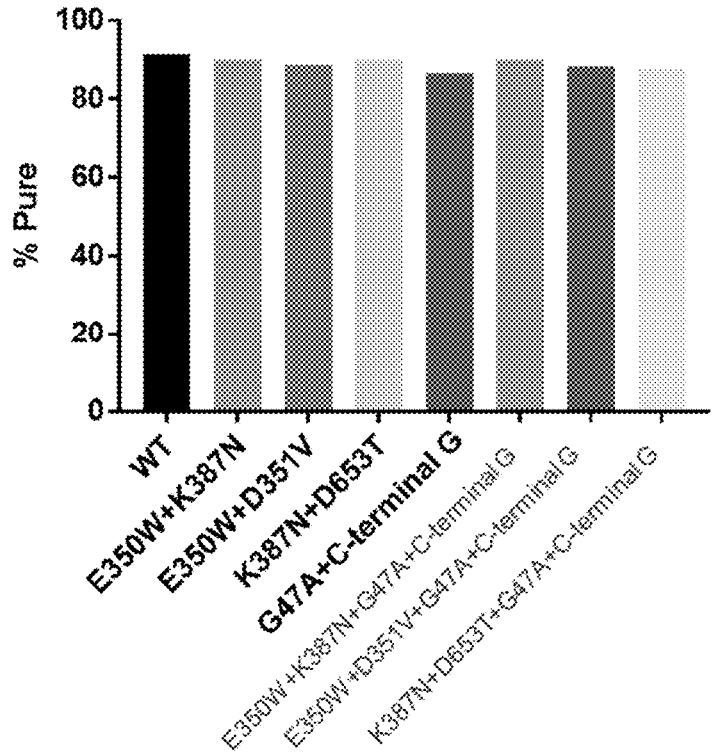
Figure 15E:
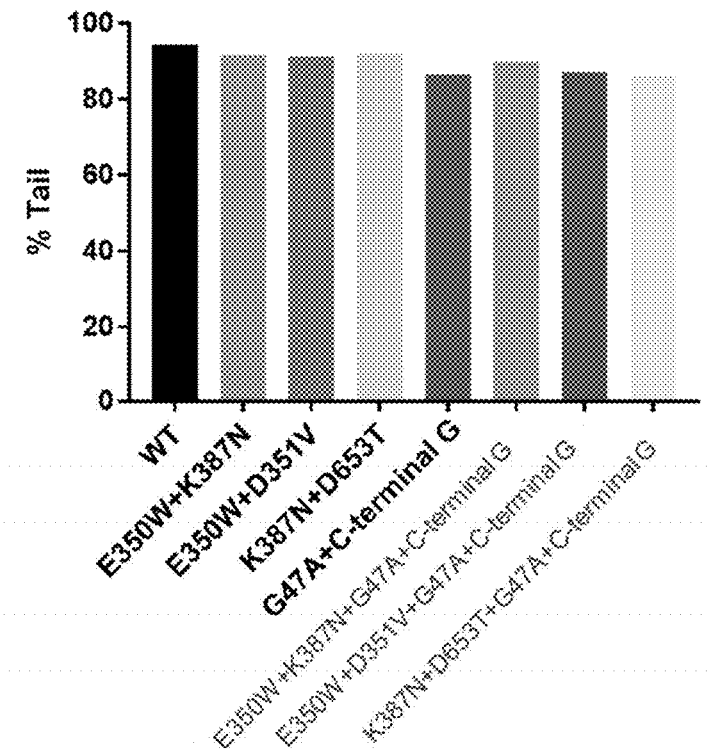

FIGS. 15A-15E show graphs depicting the functional characteristics of transcribed RNA products resulting from IVT reactions involving multi-substitution RNA polymerase variants in the presence of GGAG tetranucleotide cap analog. Following an oligo dT purification, transcribed RNA products were analyzed for yield of RNA (FIG. 15A), percent capped RNA (FIG. 15B), amount of dsRNA (FIG. 15C), purity according to a RP HPLC method (FIG. 15D), and percent tailed RNA (i.e., percent of RNA comprising a polyA tail) (FIG. 15E).

DETAILED DESCRIPTION

RNA polymerase (DNA-dependent RNA polymerase) is an enzyme that catalyzes the sequential addition of a ribonucleotide to the 3' end of a growing RNA chain (transcription of RNA in the 5'→3' direction), with nucleoside triphosphates (NTPs) acting as substrates for the enzyme and with the sequence of nucleotides specified by a DNA template. Transcription relies on the complementary pairing of bases. The two strands of a double helix separate locally, and one of the separated strands serves as a template (DNA template). RNA polymerase then catalyzes the alignment of free nucleotides on the DNA template by their complementary bases in the template. Thus, a RNA polymerase is considered to have RNA polymerase activity if the polymerase catalyzes the sequential addition of a ribonucleotide to the 3' end of a growing RNA chain.

DNA-directed RNA polymerases are capable of initiating synthesis of RNA without primers; the first catalytic stage of initiation is referred to as de novo RNA synthesis. De novo synthesis is a unique phase in the transcription cycle where the RNA polymerase binds two nucleotides rather than a nascent RNA polymer and a single nucleotide. For bacteriophage T7 RNA polymerase, transcription begins with a marked preference for GTP at the +1 and +2 positions. Initiating nucleotides bind RNA polymerase in locations distinct from those described for elongation complexes (Kennedy W P et al. J Mol Biol. 2007; 370(2): 256-68). Selection bias in favor of GTP as an initiating nucleotide is achieved by shape complementarity, extensive protein side-chain, and strong base-stacking interactions for the guanine moiety in the enzyme active site. Thus, an initiating GTP provides the largest stabilization force for the open promoter conformation (Kennedy et al. 2007). The RNA polymerase variants of the present disclosure, in some embodiments, comprise one or more amino acid substitution(s) at one or more binding site residue(s) for de novo RNA synthesis, which, without being bound by theory, alters RNA polymerase affinity to the cap analog of an in vitro transcription reaction, for example, such that there is an improvement in capping efficiency at low cap analog concentrations.

Thus, the present disclosure, in some aspects, provides RNA polymerase variants that comprises a RNA polymerase that includes an amino acid substitution at a binding site residue for de novo RNA synthesis. A RNA polymerase variant is an enzyme having RNA polymerase activity and at least one substitution and/or modification relative to the counterpart wild-type RNA polymerase. In some embodiments, the amino acid substitution at a binding site residue is a substitution at a position selected from positions 350, 351, 387, 394, 425, 427, 437, 441, 506, 628, 632, 653, 657, 811, and 880, relative to the wild-type RNA polymerase, wherein the wild-type RNA polymerase comprises the amino acid sequence of SEQ ID NO: 1. In some embodiments, the amino acid substitution at a binding site residue is a substitution at a position selected from positions 350, 351, 387, 394, 437, 441, 506, 628, 632, 653, and 657, relative to the wild-type RNA polymerase, wherein the wild-type RNA polymerase comprises the amino acid sequence of SEQ ID NO: 1.

Structural studies of T7 RNA polymerase have shown that the conformation of the N-terminal domain changes substantially between the initiation phase and elongation phase of transcription. The N-terminal domain comprises a C-helix subdomain and the promoter binding domain, which includes two segments separated by subdomain H. The promoter binding domain and the bound promoter rotate by approximately 45 degrees upon synthesis of an 8-nt RNA transcript, allowing the promoter contacts to be maintained while the active site is expanded to accommodate a growing heteroduplex. The C-helix subdomain moves modestly toward its elongation conformation, whereas subdomain H remains in its initiation- rather than its elongation-phase location, more than 70 angstroms away. Comparison of the structures of the T7 RNA polymerase initiation and elongation complexes reveal extensive conformational changes within the N-terminal 267 residues (N-terminal domain) and little change in the rest of the RNA polymerase. A rigid body rotation of the promoter binding domain as well as the refolding of the N-terminal C-helix (residues 28-71) and H (residues 151-190) subdomains are responsible for abolishing the promoter binding site, enlarging the active site and creating an exit tunnel for the RNA transcript. In particular, residues E42-G47 of T7 RNA polymerase, which exist as a R-loop structure in the initiation complex, adopt an α-helical structure in the elongation complex. The structural changes within the N-terminal domain account for the increased stability and the processivity of the elongation complex (see, e.g., Durniak, K. J. et al., Science 322(5901): 553-557, 2008, incorporated herein by reference).

Provided herein, in some aspects, are RNA polymerase variants (e.g., T7 RNA polymerase variants) that facilitate the conformational change from the RNA polymerase initiation complex to the RNA polymerase elongation complex. In some embodiments, a RNA polymerase variant comprises at least one amino acid modification, relative to wild-type RNA polymerase, that causes at least one three-dimensional loop structure of the RNA polymerase variant to undergo a conformational change to a helix structure as the RNA polymerase variant transitions from an initiation complex to an elongation complex. Thus, in some embodiments, at least one amino acid modification has a high-helix propensity, relative to wild-type amino acid. In some embodiments, a RNA polymerase variant comprises an amino acid substitution at one or more of positions 42, 43, 44, 45, 46, and 47, relative to the wild-type RNA polymerase, wherein the wild-type RNA polymerase comprises the amino acid sequence of SEQ ID NO: 1. In some embodiments, the amino acid substitution at position 47 is G47A.

Examples of loop structures include but are not limited to amino acid (aa) 42-47 in the C-helix structure (e.g., aa 28-71 of SEQ ID NO:1) of the T7 RNA polymerase initiation complex (IC) conformation and aa 257-262 in the C-linker structure (e.g., aa 258-266 of SEQ ID NO:1) of the IC.

Thus, some aspects of the present disclosure provide RNA polymerase variants that comprise multiple amino acid substitutions and/or modifications, relative to wild-type RNA polymerase. In some embodiments, a RNA polymerase variant comprise a RNA polymerase that includes (a) an amino acid substitution at a binding site residue for de novo RNA synthesis, and (b) an amino acid substitution that facilitates the conformational change from the RNA polymerase initiation complex to the RNA polymerase elongation complex.

Further, the RNA polymerase variants provided herein, in some embodiments, includes an amino acid modification comprising at least one additional amino acid at the C terminus of the polymerase. The at least one additional amino acid, in some embodiments, is selected from alanine, arginine, asparagine, aspartic acid, cysteine, glutamic acid, glutamine, glycine, histidine, isoleucine, leucine, lysine, methionine, phenylalanine, proline, serine, threonine, tryptophan, tyrosine, and valine. In some embodiments, the at least one additional amino acid is a polar amino acid. In some embodiments, the at least one additional amino acid is a non-polar amino acid. In some embodiments, the at least one additional amino acid is glycine. In some embodiments, the at least one additional amino acid is alanine. In some embodiments, the at least one additional amino acid is serine.

Use of the RNA polymerase variants of the present disclosure, for example, in an in vitro transcription reaction, in some embodiments, increases transcription efficiency, relative to a control RNA polymerase. For example, use of a RNA polymerase variant may increase the transcription efficiency (e.g., RNA yield and/or rate of transcription) by at least 20%. In some embodiments, use of a RNA polymerase variant increases the transcription efficiency (e.g., RNA yield and/or rate of transcription) by at least 30%, at least 40%, at least 50%, at least 60%, at least 70%, at least 80%, at least 90%, or at least 10%. In some embodiments, use of a RNA polymerase variant increases the transcription efficiency by 20-100%, 20-90%, 20-80%, 20-70%, 20-60%, 20-50%, 30-100%, 30-90%, 30-80%, 30-70%, 30-60%, 30-50%, 40-100%, 40-90%, 40-80%, 40-70%, 40-60%, 40-50%, 50-100%, 50-90%, 50-80%, 50-70%, or 50-60%. In some embodiments, use of a RNA polymerase variant increases the total RNA yield by at least 30%, at least 40%, at least 50%, at least 60%, at least 70%, at least 80%, at least 90%, or at least 10%. In some embodiments, use of a RNA polymerase variant increases the total RNA yield by 20-100%, 20-90%, 20-80%, 20-70%, 20-60%, 20-50%, 30-100%, 30-90%, 30-80%, 30-70%, 30-60%, 30-50%, 40-100%, 40-90%, 40-80%, 40-70%, 40-60%, 40-50%, 50-100%, 50-90%, 50-80%, 50-70%, or 50-60%. In some embodiments, use of a RNA polymerase variant increases the rate of transcription by at least 30%, at least 40%, at least 50%, at least 60%, at least 70%, at least 80%, at least 90%, or at least 10%. In some embodiments, use of a RNA polymerase variant increases the rate of transcription by 20-100%, 20-90%, 20-80%, 20-70%, 20-60%, 20-50%, 30-100%, 30-90%, 30-80%, 30-70%, 30-60%, 30-50%, 40-100%, 40-90%, 40-80%, 40-70%, 40-60%, 40-50%, 50-100%, 50-90%, 50-80%, 50-70%, or 50-60%. In some embodiments, the control RNA polymerase is a wild-type RNA polymerase comprising the amino acid sequence of SEQ ID NO: 1 ("wild-type T7 RNA polymerase"). In other embodiments, the control RNA polymerase is a RNA polymerase variant comprising an amino acid sequence of SEQ ID NO: 1 modified to include G47A substitution and an additional glycine at its C-terminus ("control T7 RNA polymerase variant" or "G47A+C-terminal G T7 RNA polymerase variant" or "control RNA polymerase variant" or "G47A+C-terminal G RNA polymerase variant").

Surprisingly, the data provided herein show that use of the RNA polymerase variants of the present disclosure in an in vitro transcription reaction enable the use of a much lower concentration (amount) of cap analog to produce an amount of capped RNA equivalent to that produced using the wild-type T7 RNA polymerase or the control RNA polymerase variant. In some embodiments, use of the RNA polymerase variants of the present disclosure, for example, in an in vitro transcription reaction increases the yield of capped RNA when half the concentration of a cap analog use in the in vitro transcription reaction. In some embodiments, use of the RNA polymerase variants of the present disclosure, for example, in an in vitro transcription reaction increases the yield of capped RNA when only 25%, 50%, or 75% of the concentration of a cap analog is use in the in vitro transcription reaction. For example, use of a RNA polymerase variant may increase the yield of capped RNA by at least 20%, when only 25%, 50%, or 75% of the concentration of a cap analog is use in the in vitro transcription reaction. In some embodiments, use of a RNA polymerase variant increases the yield of capped RNA by at least 30%, at least 40%, at least 50%, at least 60%, at least 70%, at least 80%, at least 90%, or at least 100%, when only 25%, 50%, or 75% of the concentration of a cap analog is use in the in vitro transcription reaction. In some embodiments, use of a RNA polymerase variant increases the yield of capped RNA by 20-100%, 20-90%, 20-80%, 20-70%, 20-60%, 20-50%, 30-100%, 30-90%, 30-80%, 30-70%, 30-60%, 30-50%, 40-100%, 40-90%, 40-80%, 40-70%, 40-60%, 40-50%, 50-100%, 50-90%, 50-80%, 50-70%, or 50-60%, when only 25%, 50%, or 75% of the concentration of a cap analog is use in the in vitro transcription reaction. In some embodiments, the control RNA polymerase is a wild-type T7 RNA polymerase. In other embodiments, the control RNA polymerase is a control RNA polymerase variant.

In some embodiments, use of a RNA polymerase variant increases the total yield of capped RNA by at least 30%, at least 40%, at least 50%, at least 60%, at least 70%, at least 80%, at least 90%, or at least 10%. In some embodiments, use of a RNA polymerase variant increases the total yield of capped RNA by 20-100%, 20-90%, 20-80%, 20-70%, 20-60%, 20-50%, 30-100%, 30-90%, 30-80%, 30-70%, 30-60%, 30-50%, 40-100%, 40-90%, 40-80%, 40-70%, 40-60%, 40-50%, 50-100%, 50-90%, 50-80%, 50-70%, or 50-60%.

In some embodiments, use of the RNA polymerase variants of the present disclosure, for example, in an in vitro transcription reaction increases the co-transcriptional capping efficiency. For example, use of a RNA polymerase variant may increase the co-transcriptional capping efficiency (e.g., percentage of transcript comprising cap analog) by at least 20%. In some embodiments, use of a RNA polymerase variant increases the co-transcriptional capping efficiency (e.g., percentage of transcript comprising cap analog) by at least 30%, at least 40%, at least 50%, at least 60%, at least 70%, at least 80%, at least 90%, or at least 100%. In some embodiments, use of a RNA polymerase variant increases the co-transcriptional capping efficiency by 20-100%, 20-90%, 20-80%, 20-70%, 20-60%, 20-50%, 30-100%, 30-90%, 30-80%, 30-70%, 30-60%, 30-50%, 40-100%, 40-90%, 40-80%, 40-70%, 40-60%, 40-50%, 50-100%, 50-90%, 50-80%, 50-70%, or 50-60%. In some embodiments, the control RNA polymerase is a wild-type T7 RNA polymerase. In other embodiments, the control RNA polymerase is a control RNA polymerase variant.

In some embodiments, at least 50% of the mRNA comprises a functional cap analog. For example, at least 50%, at least 55%, at least 60%, at least 65%, at least 70%, at least 75%, at least 80%, at least 85%, at least 95%, or 100% of the mRNA may comprise a cap analog. In some embodiments, 50%-100%, 50%-90%, 50%-80%, or 50%-70% of the mRNA comprises a cap analog.

In some embodiments, use of the RNA polymerase variants of the present disclosure, for example, in an in vitro transcription reaction improves 3' homogeneity of RNA at half the concentration of a cap analog use in the in vitro transcription reaction. For example, use of a RNA polymerase variant may improve 3' homogeneity of RNA by at least 20%, when only 25%, 50%, or 75% of the concentration of a cap analog is use in the in vitro transcription reaction. In some embodiments, use of a RNA polymerase variant improves 3' homogeneity by at least 30%, at least 40%, at least 50%, at least 60%, at least 70%, at least 80%, at least 90%, or at least 100%, when only 25%, 50%, or 75% of the concentration of a cap analog is use in the in vitro transcription reaction. In some embodiments, use of a RNA polymerase variant improves 3' homogeneity by 20-100%, 20-90%, 20-80%, 20-70%, 20-60%, 20-50%, 30-100%, 30-90%, 30-80%, 30-70%, 30-60%, 30-50%, 40-100%, 40-90%, 40-80%, 40-70%, 40-60%, 40-50%, 50-100%, 50-90%, 50-80%, 50-70%, or 50-60%, when only 25%, 50%, or 75% of the concentration of a cap analog is use in the in vitro transcription reaction. In some embodiments, the control RNA polymerase is a wild-type T7 RNA polymerase. In other embodiments, the control RNA polymerase is a control RNA polymerase variant.

In some embodiments, at least 50% of the mRNA produced in an in vitro transcription reaction that comprises a RNA polymerase variant of the present disclosure exhibits 3' homogeneity. For example, at least 55%, at least 60%, at least 65%, at least 70%, at least 75%, at least 80%, at least 85%, at least 95%, or 100% of the mRNA exhibits 3' homogeneity. In some embodiments, 50%-100%, 50%-90%, 50%-80%, or 50%-70% of the mRNA exhibits 3' homogeneity.

In some embodiments, the mRNA produced in an in vitro transcription reaction that comprises a RNA polymerase variant of the present disclosure has greater than a threshold 3' homogeneity. In some embodiments, the threshold is 50% or at least 50%. For example, the threshold may be 55%, 60%, 65%, 70%, 75%, 80%, 85%, or 90%.

In some embodiments, use of the RNA polymerase variants of the present disclosure, for example, in an in vitro transcription reaction improves fidelity (e.g., mutation rate) of transcription. For example, use of a RNA polymerase variant may improve fidelity of transcription by at least 20%. In some embodiments, use of a RNA polymerase variant improves fidelity of transcription by at least 30%, at least 40%, at least 50%, at least 60%, at least 70%, at least 80%, at least 90%, or at least 100%. In some embodiments, use of a RNA polymerase variant improves fidelity of transcription by 20-100%, 20-90%, 20-80%, 20-70%, 20-60%, 20-50%, 30-100%, 30-90%, 30-80%, 30-70%, 30-60%, 30-50%, 40-100%, 40-90%, 40-80%, 40-70%, 40-60%, 40-50%, 50-100%, 50-90%, 50-80%, 50-70%, or 50-60%. A RNA polymerase variant of the present disclosure that improves fidelity of transcription will produce RNA transcript (e.g., mRNA transcript) with a lower rate or total number of mutations than a control RNA polymerase. In some embodiments, the control RNA polymerase is a wild-type T7 RNA polymerase. In other embodiments, the control RNA polymerase is a control RNA polymerase variant.

In some embodiments, the mRNA produced using a RNA polymerase variant of the present disclosure has less than 1 mutation per 100 nucleotides relative to the DNA template. For example, the mRNA produced may have less than 1 mutation per 200, 300, 400, 500, 600, 700, 800, 900 or 1000 nucleotides relative to the DNA template.

In some embodiments, use of the RNA polymerase variants of the present disclosure, for example, in an in vitro transcription reaction lowers the amount of double-stranded RNA (dsRNA) contamination in the in vitro transcription reaction. For example, use of a RNA polymerase variant may lower the amount of dsRNA contamination in the in vitro transcription reaction by at least 20%. In some embodiments, use of a RNA polymerase variant lowers the amount of dsRNA contamination in the in vitro transcription reaction by at least 30%, at least 40%, at least 50%, at least 60%, at least 70%, at least 80%, at least 90%, or at least 100%. In some embodiments, use of a RNA polymerase variant lowers the amount of dsRNA contamination in the in vitro transcription reaction by 20-100%, 20-90%, 20-80%, 20-70%, 20-60%, 20-50%, 30-100%, 30-90%, 30-80%, 30-70%, 30-60%, 30-50%, 40-100%, 40-90%, 40-80%, 40-70%, 40-60%, 40-50%, 50-100%, 50-90%, 50-80%, 50-70%, or 50-60%. In some embodiments, the control RNA polymerase is a wild-type T7 RNA polymerase. In other embodiments, the control RNA polymerase is a control RNA polymerase variant.

In some embodiments, the concentration of dsRNA contamination is less than 10 ng per 25 µg of mRNA product. In some embodiments, the concentration of dsRNA contamination is less than 5 ng per 25 µg of mRNA product. For example, the concentration of dsRNA contamination may be less than 4 ng per 25 µg of mRNA product, less than 3 ng per 25 µg of mRNA product, less than 2 ng per 25 µg of mRNA product, or less than less than 1 ng per 25 µg of mRNA product. In some embodiments, the concentration of dsRNA contamination is 0.5-1, 0.5-2, 0.5-3, 0-.4, or 0.5-5 ng per 25 µg of mRNA product.

In some embodiments, the mRNA produced in an in vitro transcription reaction that comprises a RNA polymerase variant of the present disclosure has lower than a threshold quantity of dsRNA. In some embodiments, the threshold is 10 ng. In some embodiments, the threshold is 5 ng. In some embodiments, the threshold is 4 ng, 3 nm, 2 ng, or 1 ng.

Amino Acid Substitutions and Modifications

RNA polymerase variants of the present disclosure include at least one amino acid substitution, relative to the wild type (WT) RNA polymerase. For example, with reference to WT T7 RNA polymerase having an amino acid sequence of SEQ ID NO:1, the glycine at position 47 is considered a "wild-type amino acid," whereas a substitution of the glycine for alanine at position 47 is considered an "amino acid substitution" that has a high-helix propensity. In some embodiments, the RNA polymerase variant is a T7 RNA polymerase variant comprising at least one (one or more) amino acid substitution relative to WT RNA polymerase (e.g., WT T7 RNA polymerase having an amino acid sequence of SEQ ID NO: 1).

In some embodiments, a RNA polymerase variant comprises a RNA polymerase that includes an (at least one) amino acid modification causes a loop structure of the RNA polymerase variant to undergo a conformational change to a helix structure as the RNA polymerase variant transitions from an initiation complex to an elongation complex. In some embodiments, the amino acid modification is an amino acid substitution at one or more of positions 42, 43, 44, 45, 46, and 47, relative to the wild-type RNA polymerase, wherein the wild-type RNA polymerase comprises the amino acid sequence of SEQ ID NO: 1. The amino acid substitution, in some embodiments, is a high propensity amino acid substitution. Examples of high-helix propensity amino acids include alanine, isoleucine, leucine, arginine, methionine, lysine, glutamine, and/or glutamate. In some embodiments, the amino acid substitution at position 47 is G47A.

In some embodiments, a RNA polymerase variant comprise a RNA polymerase that includes an additional C-terminal amino acid, relative to the wild-type RNA polymerase. The additional C-terminal amino acid, in some embodiments, is selected from glycine, alanine, threonine, proline, glutamine, and serine. In some embodiments, the additional C-terminal amino acid (e.g., at position 884 relative to wild-type RNA polymerase comprising the amino acid sequence of SEQ ID NO: 1) is glycine.

In some embodiments, a RNA polymerase variant comprises a RNA polymerase that includes an (at least one) amino acid modification at a position that is not a conserved amino acid residue. Conserved amino acid residues are amino acids or amino acid types (e.g., individual amino acids such as Gly or Ser, or groups of amino acids that share similar properties such as amino acids with acidic functional groups) that are generally shared across multiple homologous sequences of the same protein. Conserved amino acid residues can be identified using sequence alignments of homologous amino acid sequences. A sequence alignment of approximately 1000 RNA polymerase sequences obtained using a Basic Local Alignment search allowed for a determination of the 240 positions of SEQ ID NO: 1 that are most likely to be conserved across RNA polymerase sequences. These 240 positions of SEQ ID NO: 1 that are most likely to be conserved across RNA polymerase sequences are at positions 5-6, 39, 269-277, 279, 281-282, 323-333, 411-448, 454-470, 472-474, 497-516, 532-560, 562-573, 626-646, 691, 693-702, 724-738, 775-794, 805-820, 828-833, 865-867, and 877-879. Accordingly, in some embodiments, a RNA polymerase variant of the present disclosure comprises a RNA polymerase that includes an (at least one) amino acid modification at a position that is not one of positions 5-6, 39, 269-277, 279, 281-282, 323-333, 411-448, 454-470, 472-474, 497-516, 532-560, 562-573, 626-646, 691, 693-702, 724-738, 775-794, 805-820, 828-833, 865-867, and 877-879 of SEQ ID NO: 1. In some embodiments, a RNA polymerase variant as described herein may further comprise any number of amino acid modifications at any number of positions that are not one of positions 5-6, 39, 269-277, 279, 281-282, 323-333, 411-448, 454-470, 472-474, 497-516, 532-560, 562-573, 626-646, 691, 693-702, 724-738, 775-794, 805-820, 828-833, 865-867, and 877-879 of SEQ ID NO: 1. In some embodiments, a RNA polymerase variant comprising a RNA polymerase of any one of SEQ ID NO: 2-247 may further comprise an (at least one) additional amino acid modification at a position that is not one of positions 5-6, 39, 269-277, 279, 281-282, 323-333, 411-448, 454-470, 472-474, 497-516, 532-560, 562-573, 626-646, 691, 693-702, 724-738, 775-794, 805-820, 828-833, 865-867, and 877-879. Conversely, the amino acid positions that are not conserved are most likely to be modified or mutated. Accordingly, in some embodiments, a RNA polymerase variant of the present disclosure comprises a RNA polymerase that includes an (at least one) amino acid modification at positions 1-4, 7-38, 40-268, 278, 280, 283-322, 334-410, 449-453, 471, 475-496, 517-531, 561, 574-625, 647-690, 692, 703-723, 739-774, 795-804, 821-827, 834-864, 868-876, and 880-883. In some embodiments, a RNA polymerase variant comprising a RNA polymerase of any one of SEQ ID NO: 2-247 may further comprise an (at least one) additional amino acid modification at positions 1-4, 7-38, 40-268, 278, 280, 283-322, 334-410, 449-453, 471, 475-496, 517-531, 561, 574-625, 647-690, 692, 703-723, 739-774, 795-804, 821-827, 834-864, 868-876, and 880-883.

In some embodiments, a RNA polymerase variant comprising a RNA polymerase of any one of SEQ ID NO: 2-247 may further comprise an (at least one) amino acid modification at any amino acid position that does not disrupt the secondary or tertiary structure of the RNA polymerase protein. In some embodiments, a RNA polymerase variant comprising a RNA polymerase of any one of SEQ ID NO: 2-247 may further comprise an (at least one) amino acid modification at any amino acid position that does not disrupt the ability of the RNA polymerase protein to fold. In some embodiments, a RNA polymerase variant comprising a RNA polymerase of any one of SEQ ID NO: 2-247 may further comprise an (at least one) amino acid modification at any amino acid position that does not disrupt the ability of the RNA polymerase protein to bind to nucleic acids (e.g., DNA).

In some embodiments, a RNA polymerase variant comprises a RNA polymerase that includes (a) an amino acid substitution at a position selected from positions 350, 351, 387, 394, 425, 427, 437, 441, 506, 628, 632, 653, 657, 811, and 880, and (b) an additional amino acid substitution and/or an amino acid modification at the C-terminal end, relative to wild-type RNA polymerase, wherein the wild-type RNA polymerase comprises the amino acid sequence of SEQ ID NO: 1. In some embodiments, a RNA polymerase variant comprises a RNA polymerase that includes (a) an amino acid substitution at a position selected from positions 350, 351, 387, 394, 437, 441, 506, 628, 632, 653, and 657, and (b) an additional amino acid substitution and/or an amino acid modification at the C-terminal end, relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), an amino acid substitution at position 350, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a lysine (K) at position 350 (E350K), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), an asparagine (N) at position 350 (E350N), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), an alanine (A) at position 350 (E350A), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a tryptophan at position 350 (E350W), and/or an additional amino acid (e.g., G) at the C-terminal end (at position 884), relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), an amino acid substitution at position 351, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a valine (V) at position 351 (D351V), and/or an additional amino acid (e.g., G) at the C-terminal end (at position 884), relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), an amino acid substitution at position 387, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a serine at position 387 (K387S), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a histidine (H) at position 387 (K387H), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), an asparagine at position 387 (K387N), and/or an additional amino acid (e.g., G) at the C-terminal end (at position 884), relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), an amino acid substitution at position 394, and/or an additional amino acid (e.g., G) at the C-terminal end (at position 884), relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), an amino acid substitution at position 425, and/or an additional amino acid (e.g., G) at the C-terminal end (at position 884), relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), an amino acid substitution at position 427, and/or an additional amino acid (e.g., G) at the C-terminal end (at position 884), relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), an amino acid substitution at position 437, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a threonine at position 437 (N437T), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), an isoleucine at position 437 (N437I), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a tyrosine at position 437 (N437Y), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a phenylalanine at position 437 (N437F), and/or an additional amino acid (e.g., G) at the C-terminal end (at position 884), relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), an amino acid substitution at position 441, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), an arginine at position 441 (K441R), and/or an additional amino acid (e.g., G) at the C-terminal end (at position 884), relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), an amino acid substitution at position 506, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a tryptophan (W) at position 506 (D506W), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, the amino acid substitution at position 506 is D506A, D506R, D506N, D506C, D506E, D506Q, D506G, D506H, D506I, D506L, D506K, D506M, D506F, D506P, D506S, D506T, D506W, D506Y, or D506V.

In some embodiments, a RNA polymerase variant comprises a RNA polymerase that includes an amino acid substitution at position 47 (e.g., G47A), an amino acid substitution at position 628, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a tryptophan (W) at position 628 (S628W), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, the amino acid substitution at position 628 is S628A, S628R, S628N, S628D, S628C, S628E, S628Q, S628G, S628H, S628I, S628L, S628K, S628M, S628F, S628P, S628T, S628W, S628Y, or S628V.

In some embodiments, a RNA polymerase variant comprises a RNA polymerase that includes an amino acid substitution at position 47 (e.g., G47A), an amino acid substitution at position 632, and/or an additional amino acid (e.g., G) at the C-terminal end (at position 884), relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), an amino acid substitution at position 653, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a tryptophan (W) at position 653 (D563W), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, the amino acid substitution at position 653 is D653A, D653R, D653N, D653C, D653E, D653Q, D653G, D653H, D653I, D653L, D653K, D653M, D653F, D653P, D653S, D653T, D653W, D653Y, or D653V.

In some embodiments, a RNA polymerase variant comprises a RNA polymerase that includes an amino acid substitution at position 47 (e.g., G47A), an amino acid substitution at position 657, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a tryptophan (W) at position 657 (P657W), and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), an amino acid substitution at position 811, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, the amino acid substitution at position 657 is P657A, P657R, P657N, P657D, P657C, P657E, P657Q, P657G, P657H, P657I, P657L, P657K, P657M, P657F, P657S, P657T, P657W, P657Y, or P657V.

In some embodiments, a RNA polymerase variant comprises a RNA polymerase that includes an amino acid substitution at position 47 (e.g., G47A), an amino acid substitution at position 880, and/or an additional amino acid (e.g., G) at the C-terminal end (at position 884), relative to wild-type RNA polymerase, wherein the wild-type RNA polymerase comprises the amino acid sequence of SEQ ID NO: 1. In some embodiments, a RNA polymerase variant comprises a RNA polymerase that includes an amino acid substitution at position 47 (e.g., G47A), a tyrosine at position 880 (F880Y), and/or an additional amino acid (e.g., G) at the C-terminal end (at position 884), relative to wild-type RNA polymerase, wherein the wild-type RNA polymerase comprises the amino acid sequence of SEQ ID NO: 1.

In some embodiments, a RNA polymerase variant comprises a RNA polymerase that includes an amino acid substitution at position 47 (e.g., G47A), and an additional amino acid at the C-terminal end (at position 884), relative to wild-type RNA polymerase, wherein the wild-type RNA polymerase comprises the amino acid sequence of SEQ ID NO: 1. In some embodiments, the additional amino acid at the C-terminal end is threonine (T). In some embodiments, the additional amino acid at the C-terminal end is serine (S). In some embodiments, the additional amino acid at the C-terminal end is alanine (A). In some embodiments, the additional amino acid at the C-terminal end is proline (P).

In some embodiments, a RNA polymerase variant comprises a RNA polymerase that comprises an amino acid substitution at position 350, relative to wild-type RNA polymerase, wherein the wild-type RNA polymerase comprises the amino acid sequence of SEQ ID NO: 1. In some embodiments, the amino acid substitution at position 350 is selected from the group consisting of E350R, E350K, E350H, E350D, E350Q, E350N, E350T, E350S, E350C, E350G, E350A, E350V, E350I, E350M, E350P, E350Y, E350W, and E350F. In some embodiments, the amino acid substitution at position 350 is E350R. In some embodiments, the amino acid substitution at position 350 is E350K. In some embodiments, the amino acid substitution at position 350 is E350H. In some embodiments, the amino acid substitution at position 350 is E350D. In some embodiments, the amino acid substitution at position 350 is E350Q. In some embodiments, the amino acid substitution at position 350 is E350N. In some embodiments, the amino acid substitution at position 350 is E350T. In some embodiments, the amino acid substitution at position 350 is E350S. In some embodiments, the amino acid substitution at position 350 is E350C. In some embodiments, the amino acid substitution at position 350 is E350G. In some embodiments, the amino acid substitution at position 350 is E350A. In some embodiments, the amino acid substitution at position 350 is E350V. In some embodiments, the amino acid substitution at position 350 is E350I. In some embodiments, the amino acid substitution at position 350 is E350M. In some embodiments, the amino acid substitution at position 350 is E350P. In some embodiments, the amino acid substitution at position 350 is E350Y. In some embodiments, the amino acid substitution at position 350 is E350W. In some embodiments, the amino acid substitution at position 350 is E350F.

In some embodiments, a RNA polymerase variant comprises a RNA polymerase that comprises an amino acid substitution at position 351, relative to wild-type RNA polymerase, wherein the wild-type RNA polymerase comprises the amino acid sequence of SEQ ID NO: 1. In some embodiments, the amino acid substitution at position 351 is selected from the group consisting of D351R, D351K, D351H, D351E, D351Q, D351N, D351T, D351S, D351C, D351G, D351A, D351V, D351I, D351M, D351P, D351Y, D351W, and D351F. In some embodiments, the amino acid substitution at position 351 is D351R. In some embodiments, the amino acid substitution at position 351 is D351K. In some embodiments, the amino acid substitution at position 351 is D351H. In some embodiments, the amino acid substitution at position 351 is D351E. In some embodiments, the amino acid substitution at position 351 is D351Q. In some embodiments, the amino acid substitution at position 351 is D351N. In some embodiments, the amino acid substitution at position 351 is D351T. In some embodiments, the amino acid substitution at position 351 is D351S. In some embodiments, the amino acid substitution at position 351 is D351C. In some embodiments, the amino acid substitution at position 351 is D351G. In some embodiments, the amino acid substitution at position 351 is D351A. In some embodiments, the amino acid substitution at position 351 is D351V. In some embodiments, the amino acid substitution at position 351 is D351I. In some embodiments, the amino acid substitution at position 351 is D351M. In some embodiments, the amino acid substitution at position 351 is D351P. In some embodiments, the amino acid substitution at position 351 is D351Y. In some embodiments, the amino acid substitution at position 351 is D351W. In some embodiments, the amino acid substitution at position 351 is D351F.

In some embodiments, a RNA polymerase variant comprises a RNA polymerase that comprises an amino acid substitution at position 387, relative to wild-type RNA polymerase, wherein the wild-type RNA polymerase comprises the amino acid sequence of SEQ ID NO: 1. In some embodiments, the amino acid substitution at position 387 is selected from the group consisting of K387R, K387H, K387E, K387D, K387Q, K387N, K387T, K387S, K387C, K387G, K387A, K387V, K387I, K387M, K387P, K387Y, K387W, and K387F. In some embodiments, the amino acid substitution at position 387 is K387R. In some embodiments, the amino acid substitution at position 387 is K387H. In some embodiments, the amino acid substitution at position 387 is K387E. In some embodiments, the amino acid substitution at position 387 is K387D. In some embodiments, the amino acid substitution at position 387 is K387Q. In some embodiments, the amino acid substitution at position 387 is K387N. In some embodiments, the amino acid substitution at position 387 is K387T. In some embodiments, the amino acid substitution at position 387 is K387S. In some embodiments, the amino acid substitution at position 387 is K387C. In some embodiments, the amino acid substitution at position 387 is K387G. In some embodiments, the amino acid substitution at position 387 is K387A. In some embodiments, the amino acid substitution at position 387 is K387V. In some embodiments, the amino acid substitution at position 387 is K387I. In some embodiments, the amino acid substitution at position 387 is K387M. In some embodiments, the amino acid substitution at position 387 is K387P. In some embodiments, the amino acid substitution at position 387 is K387Y. In some embodiments, the amino acid substitution at position 387 is K387W. In some embodiments, the amino acid substitution at position 387 is K387F.

In some embodiments, a RNA polymerase variant comprises a RNA polymerase that comprises an amino acid substitution at position 394, relative to wild-type RNA polymerase, wherein the wild-type RNA polymerase comprises the amino acid sequence of SEQ ID NO: 1. In some embodiments, the amino acid substitution at position 394 is selected from the group consisting of R394K, R394H, R394E, R394D, R394Q, R394N, R394T, R394S, R394C, R394G, R394A, R394V, R394I, R394M, R394P, R394Y, R394W, and R394F. In some embodiments, the amino acid substitution at position 394 is R394K. In some embodiments, the amino acid substitution at position 394 is R394H. In some embodiments, the amino acid substitution at position 394 is R394E. In some embodiments, the amino acid substitution at position 394 is R394D. In some embodiments, the amino acid substitution at position 394 is R394Q. In some embodiments, the amino acid substitution at position 394 is R394N. In some embodiments, the amino acid substitution at position 394 is R394T. In some embodiments, the amino acid substitution at position 394 is R394S. In some embodiments, the amino acid substitution at position 394 is R394C. In some embodiments, the amino acid substitution at position 394 is R394G. In some embodiments, the amino acid substitution at position 394 is R394A. In some embodiments, the amino acid substitution at position 394 is R394V. In some embodiments, the amino acid substitution at position 394 is R394I. In some embodiments, the amino acid substitution at position 394 is R394M. In some embodiments, the amino acid substitution at position 394 is R394P. In some embodiments, the amino acid substitution at position 394 is R394Y. In some embodiments, the amino acid substitution at position 394 is R394W. In some embodiments, the amino acid substitution at position 394 is R394F.

In some embodiments, a RNA polymerase variant comprises a RNA polymerase that comprises an amino acid substitution at position 425, relative to wild-type RNA polymerase, wherein the wild-type RNA polymerase comprises the amino acid sequence of SEQ ID NO: 1. In some embodiments, the amino acid substitution at position 425 is selected from the group consisting of R425K, R425H, R425E, R425D, R425Q, R425N, R425T, R425S, R425C, R425G, R425A, R425V, R425I, R425M, R425P, R425Y, R425W, and R425F. In some embodiments, the amino acid substitution at position 425 is R425K. In some embodiments, the amino acid substitution at position 425 is R425H. In some embodiments, the amino acid substitution at position 425 is R425E. In some embodiments, the amino acid substitution at position 425 is R425D. In some embodiments, the amino acid substitution at position 425 is R425Q. In some embodiments, the amino acid substitution at position 425 is R425N. In some embodiments, the amino acid substitution at position 425 is R425T. In some embodiments, the amino acid substitution at position 425 is R425S. In some embodiments, the amino acid substitution at position 425 is R425C. In some embodiments, the amino acid substitution at position 425 is R425G. In some embodiments, the amino acid substitution at position 425 is R425A. In some embodiments, the amino acid substitution at position 425 is R425V. In some embodiments, the amino acid substitution at position 425 is R425I. In some embodiments, the amino acid substitution at position 425 is R425M. In some embodiments, the amino acid substitution at position 425 is R425P. In some embodiments, the amino acid substitution at position 425 is R425Y. In some embodiments, the amino acid substitution at position 425 is R425W. In some embodiments, the amino acid substitution at position 425 is R425F.

In some embodiments, a RNA polymerase variant comprises a RNA polymerase that comprises an amino acid substitution at position 427, relative to wild-type RNA polymerase, wherein the wild-type RNA polymerase comprises the amino acid sequence of SEQ ID NO: 1. In some embodiments, the amino acid substitution at position 427 is selected from the group consisting of Y427R, Y427K, Y427H, Y427E, Y427D, Y427Q, Y427N, Y427T, Y427S, Y427C, Y427G, Y427A, Y427V, Y427I, Y427M, Y427P, Y427W, and Y427F. In some embodiments, the amino acid substitution at position 427 is Y427R. In some embodiments, the amino acid substitution at position 427 is Y427K. In some embodiments, the amino acid substitution at position 427 is Y427H. In some embodiments, the amino acid substitution at position 427 is Y427E. In some embodiments, the amino acid substitution at position 427 is Y427D. In some embodiments, the amino acid substitution at position 427 is Y427Q. In some embodiments, the amino acid substitution at position 427 is Y427N. In some embodiments, the amino acid substitution at position 427 is Y427T. In some embodiments, the amino acid substitution at position 427 is Y427S. In some embodiments, the amino acid substitution at position 427 is Y427C. In some embodiments, the amino acid substitution at position 427 is Y427G. In some embodiments, the amino acid substitution at position 427 is Y427A. In some embodiments, the amino acid substitution at position 427 is Y427V. In some embodiments, the amino acid substitution at position 427 is Y427I. In some embodiments, the amino acid substitution at position 427 is Y427M. In some embodiments, the amino acid substitution at position 427 is Y427P. In some embodiments, the amino acid substitution at position 427 is Y427W. In some embodiments, the amino acid substitution at position 427 is Y427F.

In some embodiments, a RNA polymerase variant comprises a RNA polymerase that comprises an amino acid substitution at position 437, relative to wild-type RNA polymerase, wherein the wild-type RNA polymerase comprises the amino acid sequence of SEQ ID NO: 1. In some embodiments, the amino acid substitution at position 437 is selected from the group consisting of N437R, N437K, N437H, N437E, N437D, N437Q, N437T, N437S, N437C, N437G, N437A, N437V, N437I, N437M, N437P, N437Y, N437W, and N437F. In some embodiments, the amino acid substitution at position 437 is N437R. In some embodiments, the amino acid substitution at position 437 is N437K. In some embodiments, the amino acid substitution at position 437 is N437H. In some embodiments, the amino acid substitution at position 437 is N437E. In some embodiments, the amino acid substitution at position 437 is N437D. In some embodiments, the amino acid substitution at position 437 is N437Q. In some embodiments, the amino acid substitution at position 437 is N437T. In some embodiments, the amino acid substitution at position 437 is N437S. In some embodiments, the amino acid substitution at position 437 is N437C. In some embodiments, the amino acid substitution at position 437 is N437G. In some embodiments, the amino acid substitution at position 437 is N437A. In some embodiments, the amino acid substitution at position 437 is N437V. In some embodiments, the amino acid substitution at position 437 is N437I. In some embodiments, the amino acid substitution at position 437 is N437M. In some embodiments, the amino acid substitution at position 437 is N437P. In some embodiments, the amino acid substitution at position 437 is N437Y. In some embodiments, the amino acid substitution at position 437 is N437W. In some embodiments, the amino acid substitution at position 437 is N437F.

In some embodiments, a RNA polymerase variant comprises a RNA polymerase that comprises an amino acid substitution at position 441, relative to wild-type RNA polymerase, wherein the wild-type RNA polymerase comprises the amino acid sequence of SEQ ID NO: 1. In some embodiments, the amino acid substitution at position 441 is selected from the group consisting of K441R, K441H, K441E, K441D, K441Q, K441N, K441T, K441S, K441C, K441G, K441A, K441V, K441I, K441M, K441P, K441Y, K441W, and K441F. In some embodiments, the amino acid substitution at position 441 is K441R. In some embodiments, the amino acid substitution at position 441 is K441H. In some embodiments, the amino acid substitution at position 441 is K441E. In some embodiments, the amino acid substitution at position 441 is K441D. In some embodiments, the amino acid substitution at position 441 is K441Q. In some embodiments, the amino acid substitution at position 441 is K441N. In some embodiments, the amino acid substitution at position 441 is K441T. In some embodiments, the amino acid substitution at position 441 is K441S. In some embodiments, the amino acid substitution at position 441 is K441C. In some embodiments, the amino acid substitution at position 441 is K441G. In some embodiments, the amino acid substitution at position 441 is K441A. In some embodiments, the amino acid substitution at position 441 is K441V. In some embodiments, the amino acid substitution at position 441 is K441I. In some embodiments, the amino acid substitution at position 441 is K441M. In some embodiments, the amino acid substitution at position 441 is K441P. In some embodiments, the amino acid substitution at position 441 is K441Y. In some embodiments, the amino acid substitution at position 441 is K441W. In some embodiments, the amino acid substitution at position 441 is K441F.

In some embodiments, a RNA polymerase variant comprises a RNA polymerase that comprises an amino acid substitution at position 632, relative to wild-type RNA polymerase, wherein the wild-type RNA polymerase comprises the amino acid sequence of SEQ ID NO: 1. In some embodiments, the amino acid substitution at position 632 is selected from the group consisting of R632K, R632H, R632E, R632D, R632Q, R632N, R632T, R632S, R632C, R632G, R632A, R632V, R632I, R632M, R632P, R632Y, R632W, and R632F. In some embodiments, the amino acid substitution at position 632 is R632K. In some embodiments, the amino acid substitution at position 632 is R632H. In some embodiments, the amino acid substitution at position 632 is R632E. In some embodiments, the amino acid substitution at position 632 is R632D. In some embodiments, the amino acid substitution at position 632 is R632Q. In some embodiments, the amino acid substitution at position 632 is R632N. In some embodiments, the amino acid substitution at position 632 is R632T. In some embodiments, the amino acid substitution at position 632 is R632S. In some embodiments, the amino acid substitution at position 632 is R632C. In some embodiments, the amino acid substitution at position 632 is R632G. In some embodiments, the amino acid substitution at position 632 is R632A. In some embodiments, the amino acid substitution at position 632 is R632V. In some embodiments, the amino acid substitution at position 632 is R632I. In some embodiments, the amino acid substitution at position 632 is R632M. In some embodiments, the amino acid substitution at position 632 is R632P. In some embodiments, the amino acid substitution at position 632 is R632Y. In some embodiments, the amino acid substitution at position 632 is R632W. In some embodiments, the amino acid substitution at position 632 is R632F.

In some embodiments, a RNA polymerase variant comprises a RNA polymerase that comprises an amino acid substitution at position 811, relative to wild-type RNA polymerase, wherein the wild-type RNA polymerase comprises the amino acid sequence of SEQ ID NO: 1. In some embodiments, the amino acid substitution at position 811 is selected from the group consisting of H811R, H811K, H811E, H811D, H811Q, H811N, H811T, H811S, H811C, H811G, H811A, H811V, H811I, H811M, H811P, H811Y, H811W, and H811F. In some embodiments, the amino acid substitution at position 811 is H811R. In some embodiments, the amino acid substitution at position 811 is H811K. In some embodiments, the amino acid substitution at position 811 is H811E. In some embodiments, the amino acid substitution at position 811 is H811D. In some embodiments, the amino acid substitution at position 811 is H811 Q. In some embodiments, the amino acid substitution at position 811 is H811N. In some embodiments, the amino acid substitution at position 811 is H811 T. In some embodiments, the amino acid substitution at position 811 is H811S. In some embodiments, the amino acid substitution at position 811 is H811C. In some embodiments, the amino acid substitution at position 811 is H811G. In some embodiments, the amino acid substitution at position 811 is H811A. In some embodiments, the amino acid substitution at position 811 is H811V. In some embodiments, the amino acid substitution at position 811 is H8111. In some embodiments, the amino acid substitution at position 811 is H811M. In some embodiments, the amino acid substitution at position 811 is H811P. In some embodiments, the amino acid substitution at position 811 is H811Y. In some embodiments, the amino acid substitution at position 811 is H811 W. In some embodiments, the amino acid substitution at position 811 is H811F.

In some embodiments, a RNA polymerase variant comprises a RNA polymerase that comprises an amino acid substitution at position 880, relative to wild-type RNA polymerase, wherein the wild-type RNA polymerase comprises the amino acid sequence of SEQ ID NO: 1. In some embodiments, the amino acid substitution at position 880 is selected from the group consisting of F880R, F880K, F880H, F880E, F880D, F880Q, F880N, F880T, F880S, F880C, F880G, F880A, F880V, F880I, F880M, F880P, F880Y, and F880W. In some embodiments, the amino acid substitution at position 880 is F880R. In some embodiments, the amino acid substitution at position 880 is F880K. In some embodiments, the amino acid substitution at position 880 is F880H. In some embodiments, the amino acid substitution at position 880 is F880E. In some embodiments, the amino acid substitution at position 880 is F880D. In some embodiments, the amino acid substitution at position 880 is F880Q. In some embodiments, the amino acid substitution at position 880 is F880N. In some embodiments, the amino acid substitution at position 880 is F880T. In some embodiments, the amino acid substitution at position 880 is F880S. In some embodiments, the amino acid substitution at position 880 is F880C. In some embodiments, the amino acid substitution at position 880 is F880G. In some embodiments, the amino acid substitution at position 880 is F880A. In some embodiments, the amino acid substitution at position 880 is F880V. In some embodiments, the amino acid substitution at position 880 is F880I. In some embodiments, the amino acid substitution at position 880 is F880M. In some embodiments, the amino acid substitution at position 880 is F880P. In some embodiments, the amino acid substitution at position 880 is F880Y. In some embodiments, the amino acid substitution at position 880 is F880W.

In should be understood that the RNA polymerase variants of the present disclosure may include more than one (e.g., 2, 3, 4, 5, or more) amino acid substitution and/or modification. It should also be understood that any of the RNA polymerase variants may include a G47A substitution and/or an additional C-terminal amino acid, such as glycine, relative to a wild-type RNA polymerase comprising the amino acid sequence of SEQ ID NO: 1.

In some embodiments, a RNA polymerase variant comprises a RNA polymerase that includes (a) an amino acid substitution at positions 350, 351, and 387, and (b) an additional amino acid substitution and/or an amino acid modification at the C-terminal end, relative to wild-type RNA polymerase, wherein the wild-type RNA polymerase comprises the amino acid sequence of SEQ ID NO: 1. In some embodiments, the additional amino acid substitution at position 350 is E350A. In some embodiments, the additional amino acid substitution at position 350 is E350K. In some embodiments, the additional amino acid substitution at position 350 is E350N. In some embodiments, the additional amino acid substitution at position 350 is E350W.

In some embodiments, the additional amino acid substitution at position 351 is D351V. In some embodiments, the additional amino acid substitution at position 387 is K387S. In some embodiments, the additional amino acid substitution at position 387 is K387H. In some embodiments, the additional amino acid substitution at position 387 is K387N. In some embodiments, the RNA polymerase variant comprises a G47A substitution. In some embodiments, the RNA polymerase variant comprises an additional glycine at the C-terminus.

In some embodiments, a RNA polymerase variant comprises a RNA polymerase that includes (a) an amino acid substitution at positions 437 and 441, and (b) an additional amino acid substitution and/or an amino acid modification at the C-terminal end, relative to wild-type RNA polymerase, wherein the wild-type RNA polymerase comprises the amino acid sequence of SEQ ID NO: 1. In some embodiments, the additional amino acid substitution at position 437 is N437T. In some embodiments, the additional amino acid substitution at position 437 is N437Y. In some embodiments, the additional amino acid substitution at position 437 is N437I. In some embodiments, the additional amino acid substitution at position 437 is N437F. In some embodiments, the additional amino acid substitution at position 441 is K441R. In some embodiments, the RNA polymerase variant comprises a G47A substitution. In some embodiments, the RNA polymerase variant comprises an additional glycine at the C-terminus.

In some embodiments, a RNA polymerase variant comprises a RNA polymerase that includes (a) an amino acid substitution at positions 880, and (b) an amino acid modification at the C-terminal end, relative to wild-type RNA polymerase, wherein the wild-type RNA polymerase comprises the amino acid sequence of SEQ ID NO: 1. In some embodiments, the additional amino acid substitution at position 880 is F880Y. In some embodiments, the amino acid modification at the C-terminal end is an additional alanine (A). In some embodiments, the amino acid modification at the C-terminal end is an additional serine (S). In some embodiments, the amino acid modification at the C-terminal end is an additional threonine (T). In some embodiments, the amino acid modification at the C-terminal end is an additional proline (P). In some embodiments, the RNA polymerase variant comprises a G47A substitution.

In some embodiments, a RNA polymerase variant comprises a RNA polymerase that includes (a) an amino acid substitution at positions 632, 653, and 657, and (b) an additional amino acid substitution and/or an amino acid modification at the C-terminal end, relative to wild-type RNA polymerase, wherein the wild-type RNA polymerase comprises the amino acid sequence of SEQ ID NO: 1. In some embodiments, the additional amino acid substitution at position 632 is R632K. In some embodiments, the additional amino acid substitution at position 632 is R632T. In some embodiments, the additional amino acid substitution at position 653 is D653T. In some embodiments, the additional amino acid substitution at position 653 is D653K.

In some embodiments, the additional amino acid substitution at position 657 is P657W. In some embodiments, the additional amino acid substitution at position 657 is P657R. In some embodiments, the additional amino acid substitution at position 657 is P657A. In some embodiments, the RNA polymerase variant comprises a G47A substitution. In some embodiments, the RNA polymerase variant comprises an additional glycine at the C-terminus.

In some embodiments, a RNA polymerase variant comprises a RNA polymerase that includes (a) an amino acid substitution at positions 628, 632, 653, and 657, and (b) an additional amino acid substitution and/or an amino acid modification at the C-terminal end, relative to wild-type RNA polymerase, wherein the wild-type RNA polymerase comprises the amino acid sequence of SEQ ID NO: 1. In some embodiments, the additional amino acid substitution at position 628 is S628W. In some embodiments, the additional amino acid substitution at position 632 is R632K. In some embodiments, the additional amino acid substitution at position 632 is R632T. In some embodiments, the additional amino acid substitution at position 653 is D653T. In some embodiments, the additional amino acid substitution at position 653 is D653K. In some embodiments, the additional amino acid substitution at position 657 is P657W. In some embodiments, the additional amino acid substitution at position 657 is P657R. In some embodiments, the additional amino acid substitution at position 657 is P657A. In some embodiments, the RNA polymerase variant comprises a G47A substitution. In some embodiments, the RNA polymerase variant comprises an additional glycine at the C-terminus.

In some embodiments, a RNA polymerase variant comprises a RNA polymerase that includes (a) an amino acid substitution at positions 387, 657, and 884, and (b) an additional amino acid substitution and/or an amino acid modification at the C-terminal end, relative to wild-type RNA polymerase, wherein the wild-type RNA polymerase comprises the amino acid sequence of SEQ ID NO: 1.

It should also be understood that the present disclosure encompasses RNA polymerases that have at least 90%, at least 91%, at least 92%, at least 93%, at least 94%, at least 95%, at least 96%, at least 97%, at least 98%, or at least 99% identity to the RNA polymerase variants of described herein. It should also be understood that any of the RNA polymerase variants described herein may share at least 90%, at least 91%, at least 92%, at least 93%, at least 94%, at least 95% identity with a RNA polymerase comprising the amino acid sequence of SEQ ID NO: 1.

The term "identity" refers to a relationship between the sequences of two or more polypeptides (e.g. enzymes) or polynucleotides (nucleic acids), as determined by comparing the sequences. Identity also refers to the degree of sequence relatedness between or among sequences as determined by the number of matches between strings of two or more amino acid residues or nucleic acid residues. Identity measures the percent of identical matches between the smaller of two or more sequences with gap alignments (if any) addressed by a particular mathematical model or computer program (e.g., "algorithms"). Identity of related proteins or nucleic acids can be readily calculated by known methods. "Percent (%) identity" as it applies to polypeptide or polynucleotide sequences is defined as the percentage of residues (amino acid residues or nucleic acid residues) in the candidate amino acid or nucleic acid sequence that are identical with the residues in the amino acid sequence or nucleic acid sequence of a second sequence after aligning the sequences and introducing gaps, if necessary, to achieve the maximum percent identity. Methods and computer programs for the alignment are well known in the art. It is understood that identity depends on a calculation of percent identity but may differ in value due to gaps and penalties introduced in the calculation. Generally, variants of a particular polynucleotide or polypeptide (e.g., antigen) have at least 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, et al (1997), "Gapped BLAST and PSI-BLAST: a new generation of protein database search programs", Nucleic Acids Res. 25:3389-3402). Another popular local alignment technique is based on the Smith-Waterman algorithm (Smith, T. F. & Waterman, M. S. (1981) "Identification of common molecular subsequences." J. Mol. Biol. 147:195-197). A general global alignment technique based on dynamic programming is the Needleman-Wunsch algorithm (Needleman, S. B. & Wunsch, C. D. (1970) "A general method applicable to the search for similarities in the amino acid sequences of two proteins." J. Mol. Biol. 48:443-453). More recently a Fast Optimal Global Sequence Alignment Algorithm (FOGSAA) has been developed that purportedly produces global alignment of nucleotide and protein sequences faster than other optimal global alignment methods, including the Needleman-Wunsch algorithm.

Nucleotide Cap Analogs

Also provided herein are co-transcriptional capping methods for ribonucleic acid (RNA) synthesis, using any of the RNA polymerase variants described herein. That is, RNA is produced in a "one-pot" reaction, without the need for a separate capping reaction. Thus, the methods, in some embodiments, comprise reacting a polynucleotide template with a RNA polymerase variant, nucleoside triphosphates, and a cap analog under in vitro transcription reaction conditions to produce RNA transcript.

A cap analog may be, for example, a dinucleotide cap, a trinucleotide cap, or a tetranucleotide cap. In some embodiments, a cap analog is a dinucleotide cap. In some embodiments, a cap analog is a trinucleotide cap. In some embodiments, a cap analog is a tetranucleotide cap.

A nucleotide cap (e.g., a trinucleotide cap or tetranucleotide cap), in some embodiments, comprises a compound of formula (I)

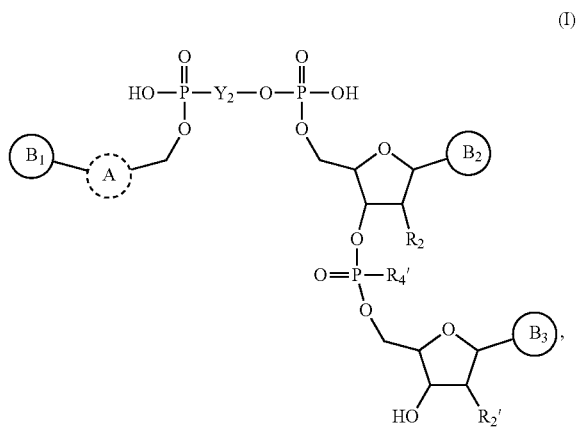

or a stereoisomer, tautomer or salt thereof, wherein

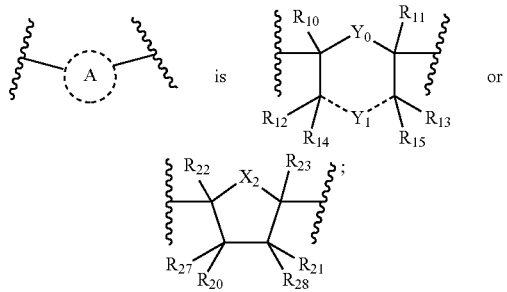

ring $B_1$ is a modified or unmodified Guanine;
ring $B_2$ and ring $B_3$ each independently is a nucleobase or a modified nucleobase;
$X_2$ is O, $S(O)_p$, $NR_{24}$ or $CR_{25}R_{26}$ in which p is 0, 1, or 2;
$Y_0$ is O or $CR_6R_7$;
Y1 is O, $S(O)_n$, $CR_6R_7$, or $NR_8$, in which n is 0, 1, or 2;
each — is a single bond or absent, wherein when each — is a single bond, Yi is O, $S(O)_n$, $CR_6R_7$, or NRs; and when each — is absent, $Y_1$ is void;
$Y_2$ is $(OP(O)R_4)_m$ in which m is 0, 1, or 2, or —O—$(CR_{40}R_{41})u$-$Q_0$-$(CR_{42}R_{43})v$-, in which $Q_0$ is a bond, O, $S(O)_r$, $NR_{44}$, or $CR_{45}R_{46}$, r is 0, 1, or 2, and each of u and v independently is 1, 2, 3 or 4;
each $R_2$ and $R_2'$ independently is halo, LNA, or $OR_3$;
each $R_3$ independently is H, $C_1$-$C_6$ alkyl, $C_2$-$C_6$ alkenyl, or $C_2$-$C_6$ alkynyl and $R_3$, when being $C_1$-$C_6$ alkyl, $C_2$-$C_6$ alkenyl, or $C_2$-$C_6$ alkynyl, is optionally substituted with one or more of halo, OH and $C_1$-$C_6$ alkoxyl that is optionally substituted with one or more OH or OC(O)—$C_1$-$C_6$ alkyl;
each $R_4$ and $R_4'$ independently is H, halo, $C_1$-$C_6$ alkyl, OH, SH, SeH, or $BH_3^-$;
each of $R_6$, $R_7$, and $R_8$, independently, is -$Q_1$-$T_1$, in which $Q_1$ is a bond or $C_1$-$C_3$ alkyl linker optionally substituted with one or more of halo, cyano, OH and $C_1$-$C_6$ alkoxy, and $T_1$ is H, halo, OH, COOH, cyano, or $R_{s1}$, in which $R_{s1}$ is $C_1$-$C_3$ alkyl, $C_2$-$C_6$ alkenyl, $C_2$-$C_6$ alkynyl, $C_1$-$C_6$ alkoxyl, C(O)O—$C_1$-$C_6$ alkyl, $C_3$-$C_8$ cycloalkyl, $C_6$-$C_{10}$ aryl, $NR_{31}R_{32}$, $(NR_{31}R_{32}R_{33})^+$, 4 to 12-membered heterocycloalkyl, or 5- or 6-membered heteroaryl, and $R_{s1}$ is optionally substituted with one or more substituents selected from the group consisting of halo, OH, oxo, $C_1$-$C_6$ alkyl, COOH, C(O)O—$C_1$-$C_6$ alkyl, cyano, $C_1$-$C_6$ alkoxyl, $NR_{31}R_{32}$, $(NR_{31}R_{32}R_{33})^+$, $C_3$-$C_8$ cycloalkyl, $C_6$-$C_{10}$ aryl, 4 to 12-membered heterocycloalkyl, and 5- or 6-membered heteroaryl; each of $R_{10}$, $R_{11}$, $R_{12}$, $R_{13}$, $R_{14}$, and $R_{15}$, independently, is -$Q_2$-$T_2$, in which $Q_2$ is a bond or $C_1$-$C_3$ alkyl linker optionally substituted with one or more of halo, cyano, OH and $C_1$-$C_6$ alkoxy, and $T_2$ is H, halo, OH, $NH_2$, cyano, $NO_2$, $N_3$, $R_{s2}$, or $OR_{s2}$, in which $R_{s2}$ is $C_1$-$C_6$ alkyl, $C_2$-$C_6$ alkenyl, $C_2$-$C_6$ alkynyl, $C_3$-$C_8$ cycloalkyl, $C_6$-$C_{10}$ aryl, NHC(O)—$C_1$-$C_6$ alkyl, $NR_{31}R_{32}$, $(NR_{31}R_{32}R_{33})^+$, 4 to 12-membered heterocycloalkyl, or 5- or 6-membered heteroaryl, and $R_{s2}$ is optionally substituted with one or more substituents selected from the group consisting of halo, OH, oxo, $C_1$-$C_6$ alkyl, COOH, C(O)O—$C_1$-$C_6$ alkyl, cyano, $C_1$-$C_6$ alkoxyl, $NR_{31}R_{32}$, $(NR_{31}R_{32}R_{33})^+$, $C_3$-$C_5$ cycloalkyl, $C_6$-$C_{10}$ aryl, 4 to 12-membered heterocycloalkyl, and 5- or 6-membered heteroaryl; or alternatively $R_{12}$ together with $R_{14}$ is oxo, or $R_{13}$ together with $R_{15}$ is oxo, each of $R_{20}$, $R_{21}$, $R_{22}$, and $R_{23}$ independently is -$Q_3$-$T_3$, in which $Q_3$ is a bond or $C_1$-$C_3$ alkyl linker optionally substituted with one or more of halo, cyano, OH and $C_1$-$C_6$ alkoxy, and $T_3$ is H, halo, OH, $NH_2$, cyano, N02, $N_3$, $R_{S3}$, or $OR_{S3}$, in which $R_{S3}$ is $C_1$-$C_6$ alkyl, $C_2$-$C_6$ alkenyl, $C_2$-$C_6$ alkynyl, $C_3$-$C_8$ cycloalkyl, $C_6$-$C_{10}$ aryl, NHC(O)—$C_1$-$C_6$ alkyl, mono-$C_1$-$C_6$ alkylamino, di-$C_1$-$C_6$ alkylamino, 4 to 12-membered heterocycloalkyl, or 5- or 6-membered heteroaryl, and $R_{S3}$ is optionally substituted with one or more substituents selected from the group consisting of halo, OH, oxo, $C_1$-$C_6$ alkyl, COOH, C(O)O—$C_1$-$C_6$ alkyl, cyano, $C_1$-$C_6$ alkoxyl, amino, mono-$C_1$-$C_6$ alkylamino, di-$C_1$-$C_6$ alkylamino, $C_3$-$C_5$ cycloalkyl, $C_6$-$C_{10}$ aryl, 4 to 12-membered heterocycloalkyl, and 5- or 6-membered heteroaryl; each of $R_{24}$, $R_{25}$, and $R_{26}$ independently is H or $C_1$-$C_6$ alkyl;

each of $R_{27}$ and $R_{28}$ independently is H or $OR_{29}$; or $R_{27}$ and $R_{28}$ together form O—$R_{30}$—O; each $R_{29}$ independently is H, $C_1$-$C_6$ alkyl, $C_2$-$C_6$ alkenyl, or $C_2$-$C_6$ alkynyl and $R_{29}$, when being $C_1$-$C_6$ alkyl, $C_2$-$C_6$ alkenyl, or $C_2$-$C_6$ alkynyl, is optionally substituted with one or more of halo, OH and $C_1$-$C_6$ alkoxyl that is optionally substituted with one or more OH or OC(O)—$C_1$-$C_6$ alkyl;

$R_{30}$ is $C_1$-$C_6$ alkylene optionally substituted with one or more of halo, OH and $C_1$-$C_6$ alkoxyl;

each of $R_{31}$, $R_{32}$, and $R_{33}$, independently is H, $C_1$-$C_6$ alkyl, $C_3$-$C_8$ cycloalkyl, $C_6$-$C_{10}$ aryl, 4 to 12-membered heterocycloalkyl, or 5- or 6-membered heteroaryl;

each of $R_{40}$, $R_{41}$, $R_{42}$, and $R_{43}$ independently is H, halo, OH, cyano, $N_3$, $OP(O)R_{47}R_{48}$, or $C_1$-$C_6$ alkyl optionally substituted with one or more $OP(O)R_{47}R_{48}$, or one $R_{41}$ and one $R_{43}$, together with the carbon atoms to which they are attached and $Q_0$, form $C_4$-$C_{10}$ cycloalkyl, 4- to 14-membered heterocycloalkyl, $C_6$-$C_{10}$ aryl, or 5- to 14-membered heteroaryl, and each of the cycloalkyl, heterocycloalkyl, phenyl, or 5- to 6-membered heteroaryl is optionally substituted with one or more of OH, halo, cyano, $N_3$, oxo, $OP(O)R_{47}R_{48}$, $C_1$-$C_6$ alkyl, $C_1$-$C_6$ haloalkyl, COOH, C(O)O—$C_1$-$C_6$ alkyl, $C_1$-$C_6$ alkoxyl, $C_1$-$C_6$ haloalkoxyl, amino, mono-$C_1$-$C_6$ alkylamino, and di-$C_1$-$C_6$ alkylamino;

$R_{44}$ is H, $C_1$-$C_6$ alkyl, or an amine protecting group;

each of $R_{45}$ and $R_{46}$ independently is H, $OP(O)R_{47}R_{48}$, or $C_1$-$C_6$ alkyl optionally substituted with one or more $OP(O)R_{47}R_{48}$, and each of $R_{47}$ and $R_{48}$, independently is H, halo, $C_1$-$C_6$ alkyl, OH, SH, SeH, or $BH_3^-$.

It should be understood that a cap analog, as provided herein, may include any of the cap analogs described in international publication WO 2017/066797, published on 20 Apr. 2017, incorporated by reference herein in its entirety.

In some embodiments, the $B_2$ middle position can be a non-ribose molecule, such as arabinose.

In some embodiments $R_2$ is ethyl-based.

Thus, in some embodiments, a trinucleotide cap comprises the following structure:

(II)

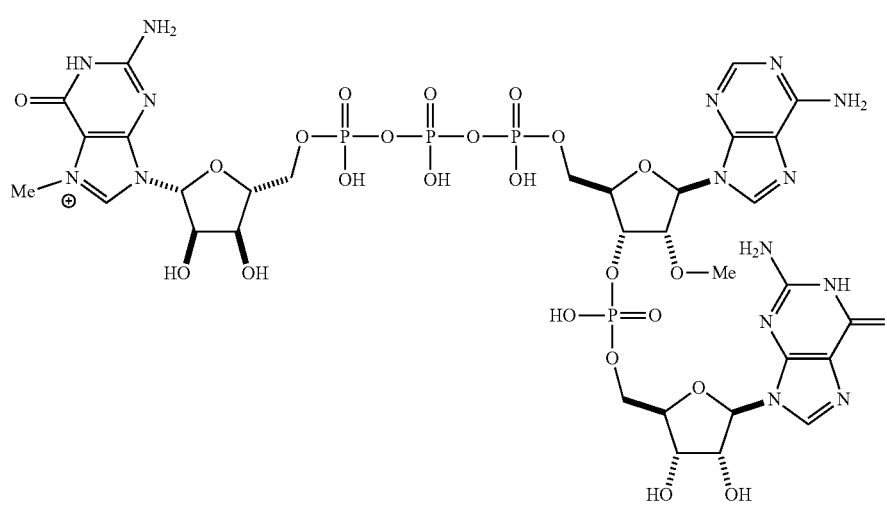

In other embodiments, a trinucleotide cap comprises the following structure:
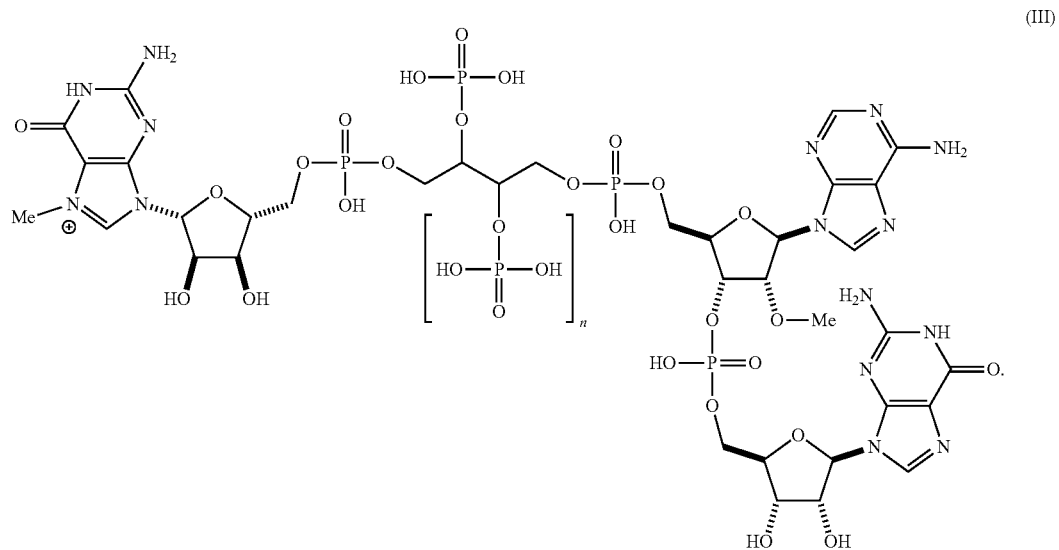
(III)
In yet other embodiments, a trinucleotide cap comprises the following structure:
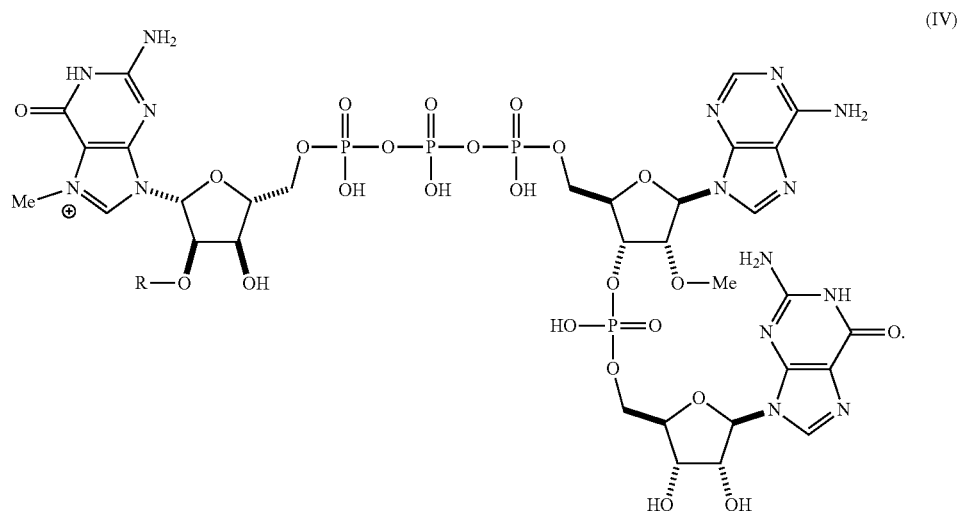
(IV)

In still other embodiments, a trinucleotide cap comprises the following structure:
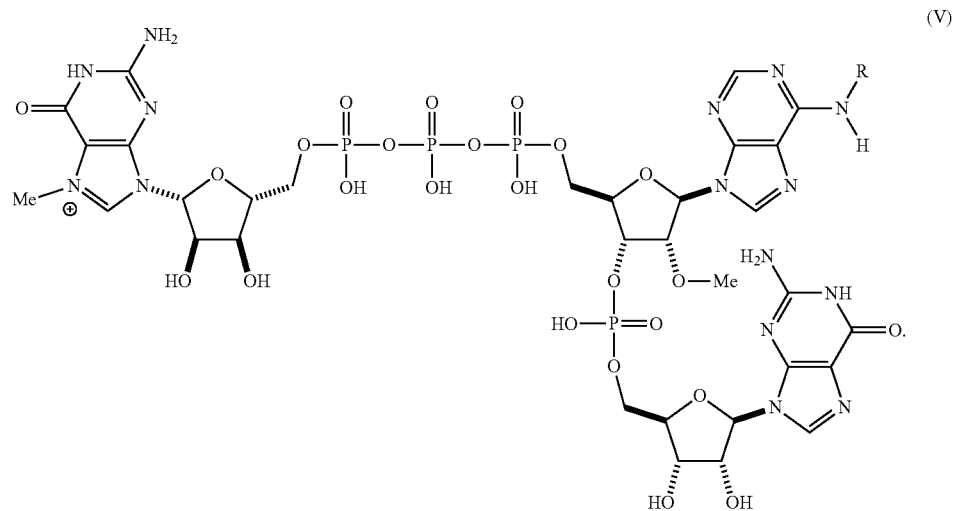
(V)
Thus, in some embodiments, a tetranucleotide cap comprises the following structure:
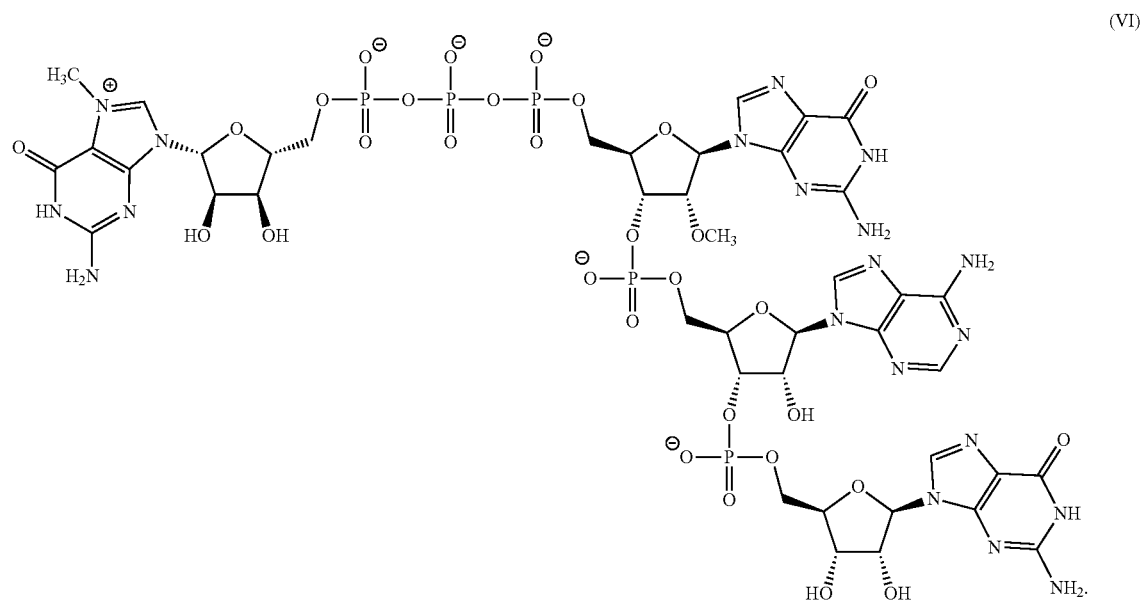 [SMILES: CO[C@@H]1[C@H](OP(=O)([O-])OC[C@H]2O[C@@H](n3cnc4c(N)ncnc43)[C@H](O)[C@@H]2OP(=O)([O-])OC[C@H]2O[C@@H](n3cnc4c(=O)[nH]c(N)nc43)[C@H](O)[C@@H]2O)[C@@H](COP(=O)([O-])OP(=O)([O-])OP(=O)([O-])OC[C@H]2O[C@@H](n3c[n+](C)c4c(=O)[nH]c(N)nc43)[C@H](O)[C@@H]2O)O[C@H]1n1cnc2c(=O)[nH]c(N)nc21]
(VI)

In other embodiments, a tetranucleotide cap comprises the following structure:
(VII)
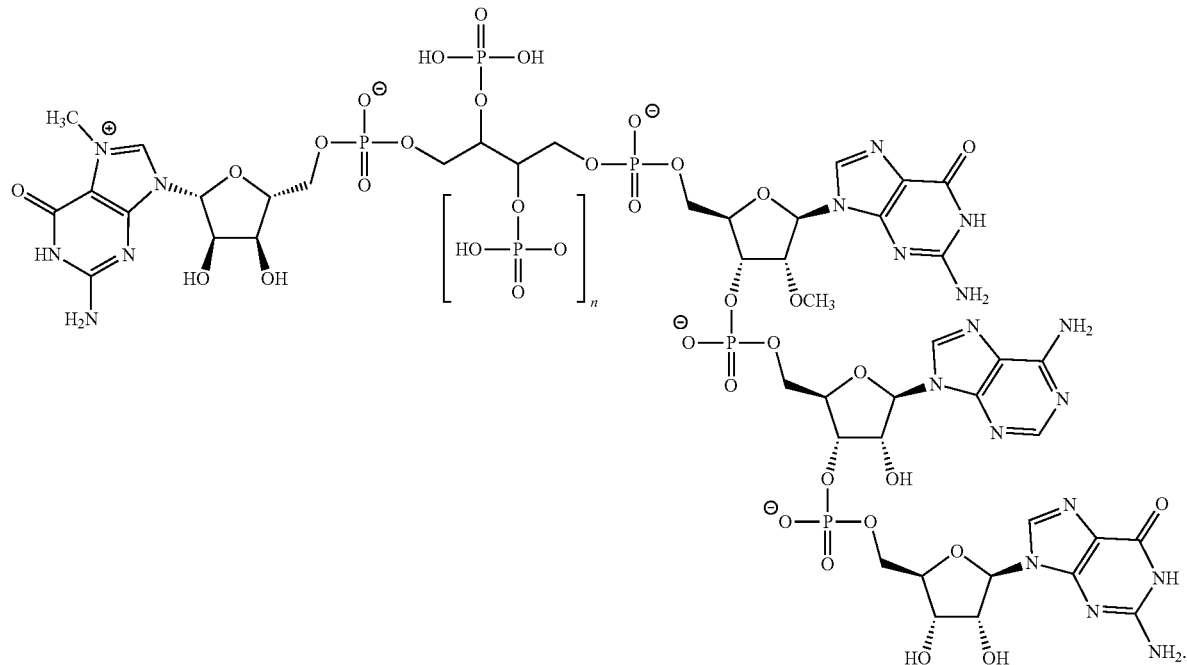
In yet other embodiments, a tetranucleotide cap comprises the following structure:
(VIII)
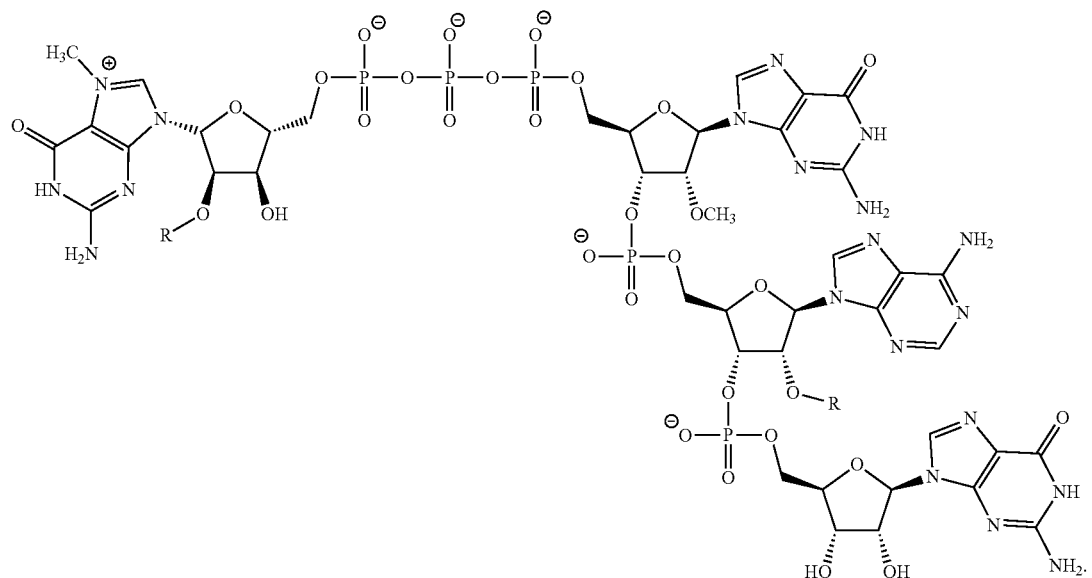

In yet other embodiments, a tetranucleotide cap comprises the following structure:

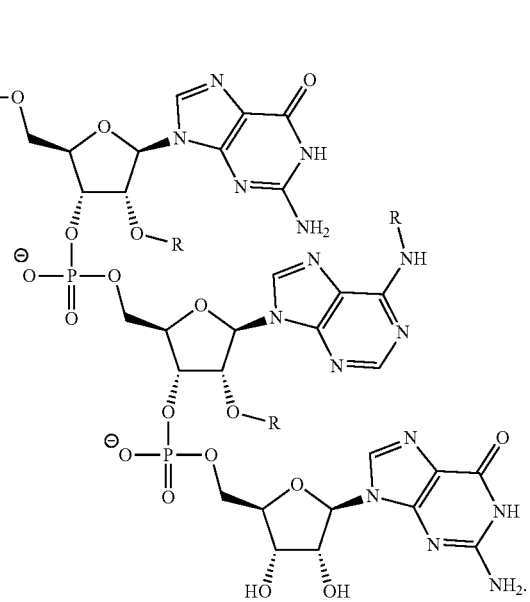

(IX)

In some embodiments, R is an alkyl (e.g., $C_1$-$C_6$ alkyl). In some embodiments, R is a methyl group (e.g., $C_1$ alkyl). In some embodiments, R is an ethyl group (e.g., $C_2$ alkyl). In some embodiments, R is a hydrogen.

A trinucleotide cap, in some embodiments, comprises a sequence selected from the following sequences: GAA, GAC, GAG, GAU, GCA, GCC, GCG, GCU, GGA, GGC, GGG, GGU, GUA, GUC, GUG, and GUU. In some embodiments, a trinucleotide cap comprises GAA. In some embodiments, a trinucleotide cap comprises GAC. In some embodiments, a trinucleotide cap comprises GAG. In some embodiments, a trinucleotide cap comprises GAU. In some embodiments, a trinucleotide cap comprises GCA. In some embodiments, a trinucleotide cap comprises GCC. In some embodiments, a trinucleotide cap comprises GCG. In some embodiments, a trinucleotide cap comprises GCU. In some embodiments, a trinucleotide cap comprises GGA. In some embodiments, a trinucleotide cap comprises GGC. In some embodiments, a trinucleotide cap comprises GGG. In some embodiments, a trinucleotide cap comprises GGU. In some embodiments, a trinucleotide cap comprises GUA. In some embodiments, a trinucleotide cap comprises GUC. In some embodiments, a trinucleotide cap comprises GUG. In some embodiments, a trinucleotide cap comprises GUU.

In some embodiments, a trinucleotide cap comprises a sequence selected from the following sequences: $m^7$GpppApA, $m^7$GpppApC, $m^7$GpppApG, $m^7$GpppApU, $m^7$GpppCpA, $m^7$GpppCpC, $m^7$GpppCpG, $m^7$GpppCpU, $m^7$GpppGpA, $m^7$GpppGpC, $m^7$GpppGpG, $m^7$GpppGpU, $m^7$GpppUpA, $m^7$GpppUpC, $m^7$GpppUpG, and $m^7$GpppUpU.

In some embodiments, a trinucleotide cap comprises $m^7$GpppApA. In some embodiments, a trinucleotide cap comprises $m^7$GpppApC. In some embodiments, a trinucleotide cap comprises $m^7$GpppApG. In some embodiments, a trinucleotide cap comprises $m^7$GpppApU. In some embodiments, a trinucleotide cap comprises $m^7$GpppCpA. In some embodiments, a trinucleotide cap comprises $m^7$GpppCpC. In some embodiments, a trinucleotide cap comprises $m^7$GpppCpG. In some embodiments, a trinucleotide cap comprises $m^7$GpppCpU. In some embodiments, a trinucleotide cap comprises $m^7$GpppGpA. In some embodiments, a trinucleotide cap comprises $m^7$GpppGpC. In some embodiments, a trinucleotide cap comprises $m^7$GpppGpG. In some embodiments, a trinucleotide cap comprises $m^7$GpppGpU. In some embodiments, a trinucleotide cap comprises $m^7$GpppUpA. In some embodiments, a trinucleotide cap comprises $m^7$GpppUpC. In some embodiments, a trinucleotide cap comprises $m^7$GpppUpG. In some embodiments, a trinucleotide cap comprises $m^7$GpppUpU.

A trinucleotide cap, in some embodiments, comprises a sequence selected from the following sequences: $m^7G_{3'OMe}$pppApA, $m^7G_{3'OMe}$pppApC, $m^7G_{3'OMe}$pppApG, $m^7G_{3'OMe}$pppApU, $m^7G_{3'OMe}$pppCpA, $m^7G_{3'OMe}$pppCpC, $m^7G_{3'OMe}$pppCpG, $m^7G_{3'OMe}$pppCpU, $m^7G_{3'OMe}$pppGpA, $m^7G_{3'OMe}$pppGpC, $m^7G_{3'OMe}$pppGpG, $m^7G_{3'OMe}$pppGpU, $m^7G_{3'OMe}$pppUpA, $m^7G_{3'OMe}$pppUpC, $m^7G_{3'OMe}$pppUpG, and $m^7G_{3'OMe}$pppUpU.

In some embodiments, a trinucleotide cap comprises $m^7G_{3'OMe}$pppApA. In some embodiments, a trinucleotide cap comprises $m^7G_{3'OMe}$pppApC. In some embodiments, a trinucleotide cap comprises $m^7G_{3'OMe}$pppApG. In some embodiments, a trinucleotide cap comprises $m^7G_{3'OMe}$pppApU. In some embodiments, a trinucleotide cap comprises $m^7G_{3'OMe}$pppCpA. In some embodiments, a trinucleotide cap comprises $m^7G_{3'OMe}$pppCpC. In some embodiments, a trinucleotide cap comprises $m^7G_{3'OMe}$pppCpG. In some embodiments, a trinucleotide cap comprises $m^7G_{3'OMe}$pppCpU. In some embodiments, a trinucleotide cap comprises $m^7G_{3'oMe}$pppGpA. In some embodiments, a trinucleotide cap comprises $m^7G_{3'OMe}$pppGpC. In some embodiments, a trinucleotide cap comprises $m^7G_{3'OMe}$pppGpG. In some embodiments, a trinucleotide cap comprises $m^7G_{3'oMe}$pppGpU. In some embodiments, a trinucleotide cap comprises $m^7G_{3'OMe}$pppUpA. In some embodiments, a trinucleotide cap comprises $m^7G_{3'OMe}$pppUpC. In some embodiments, a trinucleotide cap comprises m$^7$G$_{3'OMe}$pppUpG. In some embodiments, a trinucleotide cap comprises m$^7$G$_{3'OMe}$pppUpU.

A trinucleotide cap, in other embodiments, comprises a sequence selected from the following sequences: m$^7$G$_{3'OMe}$pppA$_{2'OMe}$pA, m$^7$G$_{3'OMe}$pppA$_{2'OMe}$pC, m$^7$G$_{3'OMe}$pppA$_{2'OMe}$pG, m$^7$G$_{3'OMe}$pppA$_{2'OMe}$pU, m$^7$G$_{3'OMe}$pppC$_{2'OMe}$pA, m$^7$G$_{3'OMe}$pppC$_{2'OMe}$pC, m$^7$G$_{3'OMe}$pppC2-oMepG, m$^7$G$_{3'OMe}$pppC$_{2'OMe}$pU, m$^7$G$_{3'OMe}$pppG$_{2'OMe}$pA, m$^7$G$_{3'OMe}$pppG$_{2'OMe}$pC, m$^7$G$_{3'OMe}$pppG$_{2'OMe}$pG, m$^7$G$_{3'OMe}$pppG$_{2'OMe}$pU, m$^7$G$_{3'OMe}$pppU$_{2'OMe}$pA, m$^7$G$_{3'OMe}$pppU$_{2'OMe}$pC, m$^7$G$_{3'OMe}$pppU$_{2'OMe}$pG, and m$^7$G$_{3'OMe}$pppU$_{2'OMe}$pU.

In some embodiments, a trinucleotide cap comprises m$^7$G$_{3'OMe}$pppA$_{2'OMe}$pA. In some embodiments, a trinucleotide cap comprises m$^7$G$_{3'OMe}$pppA$_{2'OMe}$pC. In some embodiments, a trinucleotide cap comprises m$^7$G$_{3'OMe}$pppA$_{2'OMe}$pG. In some embodiments, a trinucleotide cap comprises m$^7$G$_{3'OMe}$pppA$_{2'OMe}$pU. In some embodiments, a trinucleotide cap comprises m$^7$G$_{3'OMe}$pppC$_{2'OMe}$pA. In some embodiments, a trinucleotide cap comprises m$^7$G$_{3'OMe}$pppC$_{2'OMe}$pC. In some embodiments, a trinucleotide cap comprises m$^7$G$_{3'OMe}$pppC$_{2'OMe}$pG. In some embodiments, a trinucleotide cap comprises m$^7$G$_{3'OMe}$pppC$_{2'OMe}$pU. In some embodiments, a trinucleotide cap comprises m$^7$G$_{3'OMe}$pppG$_{2'OMe}$pA. In some embodiments, a trinucleotide cap comprises m$^7$G$_{3'OMe}$pppG$_{2'OMe}$pC. In some embodiments, a trinucleotide cap comprises m$^7$G$_{3'OMe}$pppG$_{2'OMe}$pG. In some embodiments, a trinucleotide cap comprises m$^7$G$_{3'OMe}$pppG$_{2'OMe}$pU. In some embodiments, a trinucleotide cap comprises m$^7$G$_{3'OMe}$pppU$_{2'OMe}$pA. In some embodiments, a trinucleotide cap comprises m$^7$G$_{3'OMe}$pppU$_{2'OMe}$pC. In some embodiments, a trinucleotide cap comprises m$^7$G$_{3'OMe}$pppU$_{2'OMe}$pG. In some embodiments, a trinucleotide cap comprises m$^7$G$_{3'OMe}$pppU$_{2'OMe}$pU.

A trinucleotide cap, in still other embodiments, comprises a sequence selected from the following sequences: m$^7$GpppA$_{2'OMe}$pA, m$^7$GpppA$_{2'OMe}$pC, m$^7$GpppA$_{2'OMe}$pG, m$^7$GpppA$_{2'OMe}$pU, m$^7$GpppC$_{2'OMe}$pA, m$^7$GpppC$_{2'OMe}$pC, m$^7$GpppC$_{2'OMe}$pG, m$^7$GpppC$_{2'OMe}$pU, m$^7$GpppG$_{2'OMe}$pA, m$^7$GpppG$_{2'OMe}$pC, m$^7$GpppG$_{2'OMe}$pG, m$^7$GpppG$_{2'OMe}$pU, m$^7$GpppU$_{2'OMe}$pA, m$^7$GpppU$_{2'OMe}$pC, m$^7$GpppU$_{2'OMe}$pG, and m$^7$GpppU$_{2'OMe}$pU.

In some embodiments, a trinucleotide cap comprises m$^7$GpppA$_{2'OMe}$pA. In some embodiments, a trinucleotide cap comprises m$^7$GpppA$_{2'OMe}$pC. In some embodiments, a trinucleotide cap comprises m$^7$GpppA$_{2'OMe}$pG. In some embodiments, a trinucleotide cap comprises m$^7$GpppA$_{2'OMe}$pU. In some embodiments, a trinucleotide cap comprises m$^7$GpppC$_{2'OMe}$pA. In some embodiments, a trinucleotide cap comprises m$^7$GpppC$_{2'OMe}$pC. In some embodiments, a trinucleotide cap comprises m$^7$GpppC$_{2'OMe}$pG. In some embodiments, a trinucleotide cap comprises m$^7$GpppC$_{2'OMe}$pU. In some embodiments, a trinucleotide cap comprises m$^7$GpppG$_{2'OMe}$pA. In some embodiments, a trinucleotide cap comprises m$^7$GpppG$_{2'OMe}$pC. In some embodiments, a trinucleotide cap comprises m$^7$GpppG$_{2'OMe}$pG. In some embodiments, a trinucleotide cap comprises m$^7$GpppG$_{2'OMe}$pU. In some embodiments, a trinucleotide cap comprises m$^7$GpppU$_{2'OMe}$pA. In some embodiments, a trinucleotide cap comprises m$^7$GpppU$_{2'OMe}$pC. In some embodiments, a trinucleotide cap comprises m$^7$GpppU$_{2'OMe}$pG. In some embodiments, a trinucleotide cap comprises m$^7$GpppU$_{2'oMe}$pU.

In some embodiments, a trinucleotide cap comprises m$^7$Gpppm$^6$A$_{2'Ome}$pG. In some embodiments, a trinucleotide cap comprises m$^7$Gpppe$^6$A$_{2'Ome}$pG.

In some embodiments, a trinucleotide cap comprises GAG. In some embodiments, a trinucleotide cap comprises GCG. In some embodiments, a trinucleotide cap comprises GUG. In some embodiments, a trinucleotide cap comprises GGG.

In some embodiments, a trinucleotide cap comprises any one of the following structures:

(i)

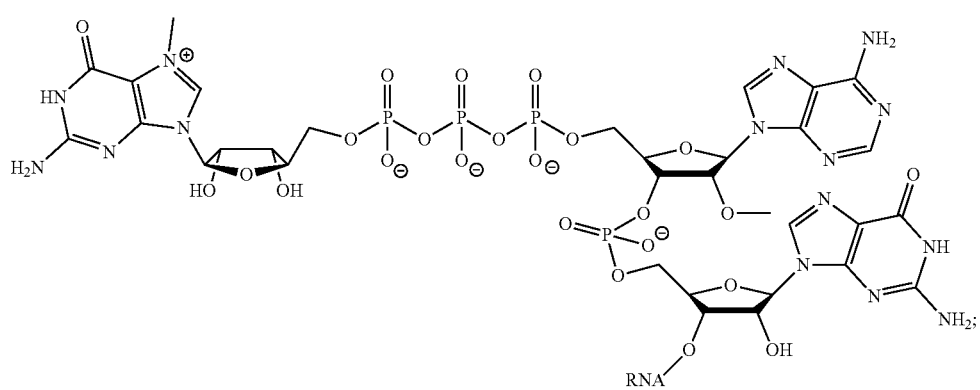

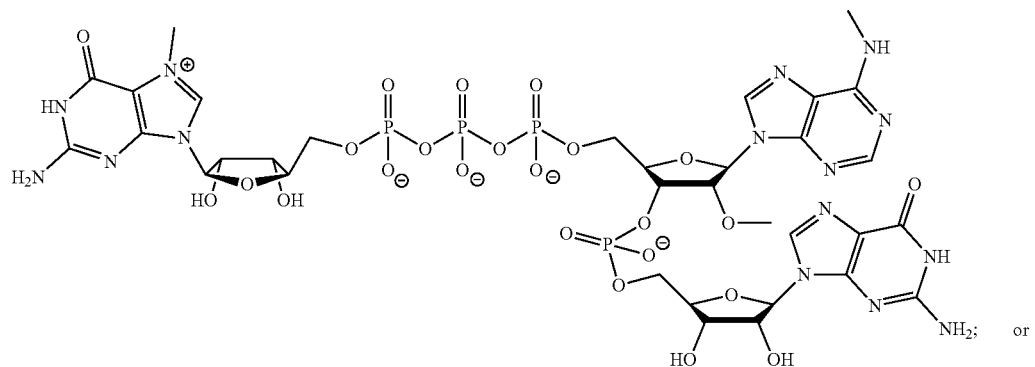
(ii)
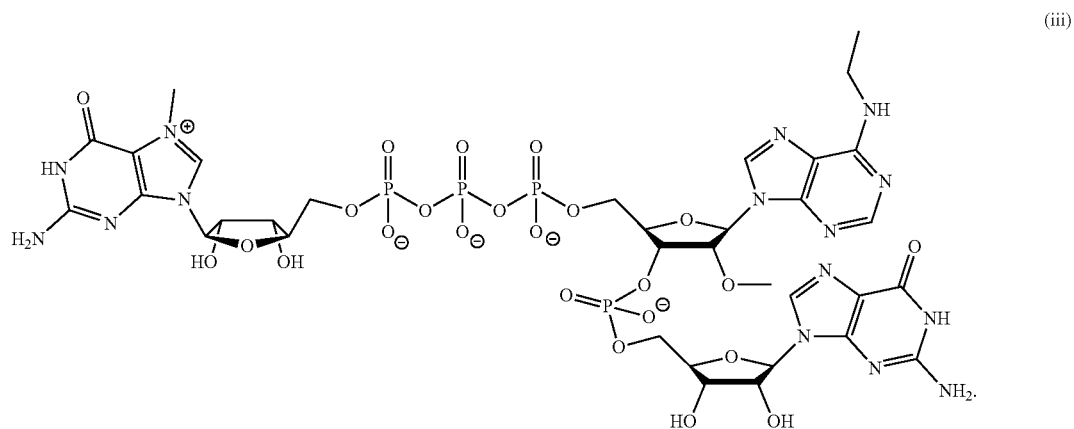
(iii)
In some embodiments, a tetranucleotide cap comprises GGAG.
In some embodiments, a tetranucleotide cap comprises any one of the following structures:
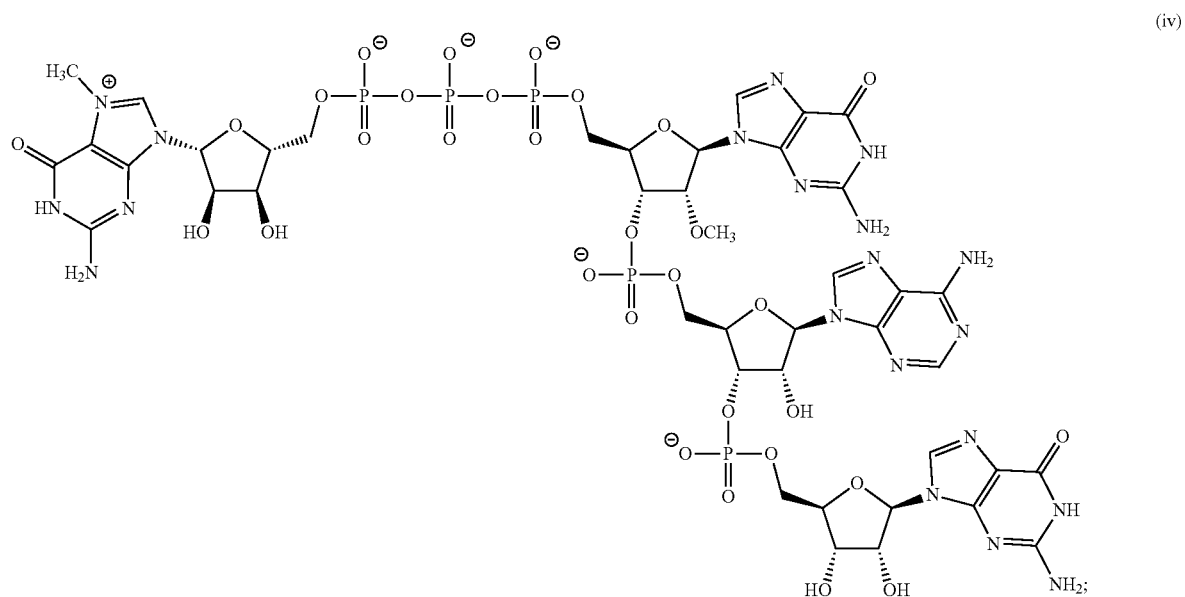
(iv)

-continued

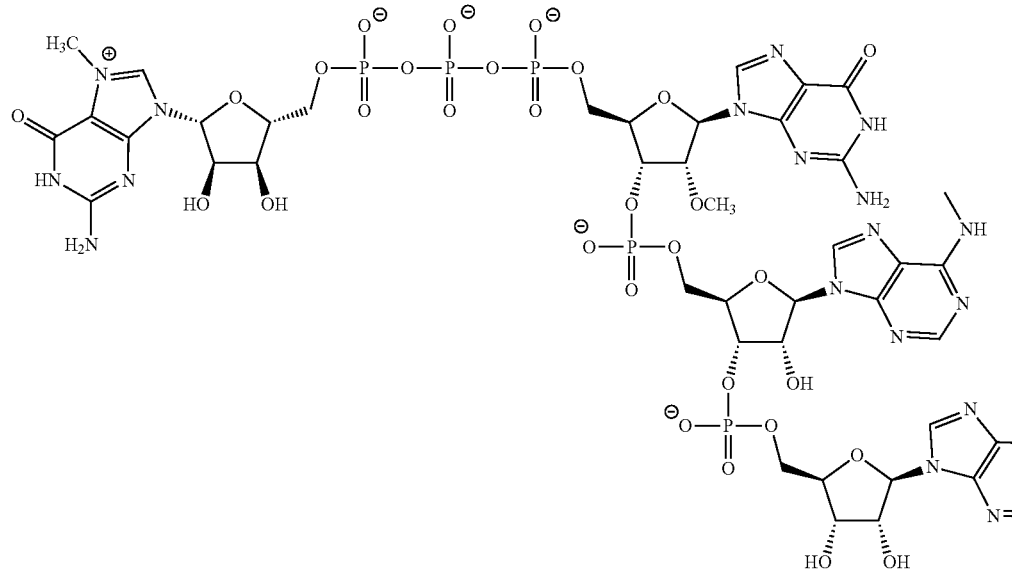

(v)

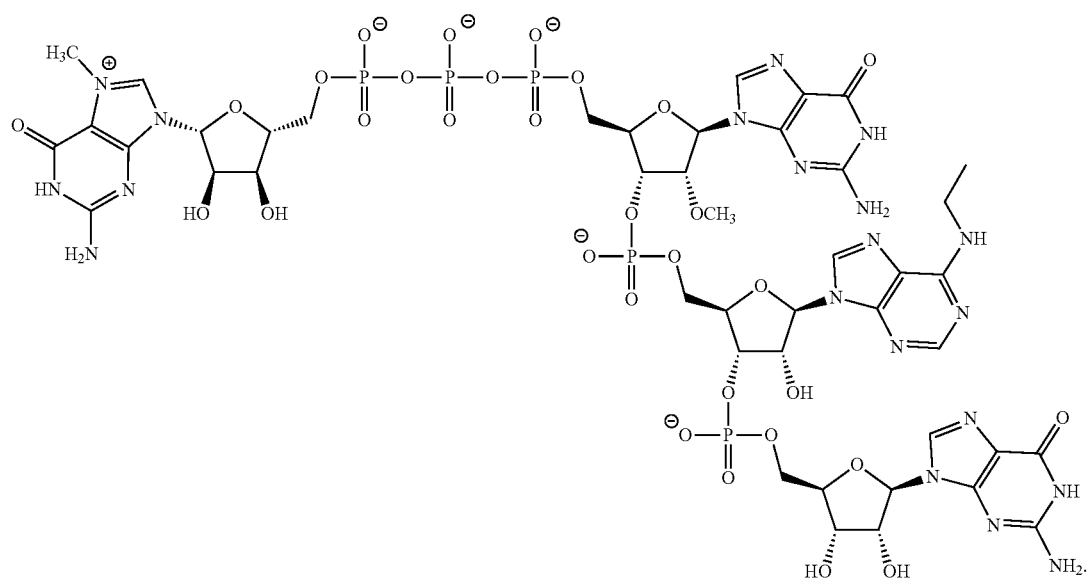

(vi)

In vitro Transcription Methods

Some aspects of the present disclosure provide methods of producing (synthesizing) a RNA transcript (e.g., mRNA transcript) comprising contacting a DNA template with a RNA polymerase (e.g., a T7 RNA polymerase such as a T7 RNA polymerase variant) under conditions that result in the production of RNA transcript.

In some embodiments, the methods comprise contacting a DNA template with a T7 RNA polymerase variant that comprises an (at least one) additional C terminal amino acid (e.g., Gly, Ala, GlyGly, AlaAla, GlyAla, or AlaGly).

In some aspects, the present disclosure provides methods of performing an IVT reaction, comprising contacting a DNA template with the RNA polymerase (e.g., a T7 RNA polymerase, such as a T7 RNA polymerase variant) in the presence of nucleoside triphosphates and buffer under conditions that result in the production of RNA transcripts.

Other aspects of the present disclosure provide co-transcriptional capping methods that comprise reacting a polynucleotide template with a T7 RNA polymerase variant, nucleoside triphosphates, and a cap analog under in vitro transcription reaction conditions to produce RNA transcript.

In some embodiments, a co-transcriptional capping method for RNA synthesis comprises reacting a polynucleotide template with (a) a T7 RNA polymerase variant comprising at least one amino acid substitution, relative to wild-type RNA polymerase, that causes at least one loop structure of the RNA polymerase variant to undergo a conformational change to a helix structure as the RNA polymerase variant transitions from an initiation complex to an elongation complex (e.g., at least one amino acid substitution positions 42, 43, 44, 45, 46, and/or 47), (b) nucleoside triphosphates, and (c) a trinucleotide cap comprising sequence $GpppA_{2'OMe}pG$, under in vitro transcription reaction conditions to produce RNA transcript, wherein the polynucleotide template includes a 2'-deoxythymidine residue at template position+1.

IVT conditions typically require a purified linear DNA template containing a promoter, nucleoside triphosphates, a buffer system that includes dithiothreitol (DTT) and magnesium ions, and a RNA polymerase. The exact conditions used in the transcription reaction depend on the amount of RNA needed for a specific application. Typical IVT reactions are performed by incubating a DNA template with a RNA polymerase and nucleoside triphosphates, including GTP, ATP, CTP, and UTP (or nucleotide analogs) in a transcription buffer. A RNA transcript having a 5' terminal guanosine triphosphate is produced from this reaction.

A deoxyribonucleic acid (DNA) is simply a nucleic acid template for RNA polymerase. A DNA template may include a polynucleotide encoding a polypeptide of interest (e.g., an antigenic polypeptide). A DNA template, in some embodiments, includes a RNA polymerase promoter (e.g., a T7 RNA polymerase promoter) located 5' from and operably linked to polynucleotide encoding a polypeptide of interest. A DNA template may also include a nucleotide sequence encoding a polyadenylation (polyA) tail located at the 3' end of the gene of interest.

Polypeptides of interest include, but are not limited to, biologics, antibodies, antigens (vaccines), and therapeutic proteins. The term "protein" encompasses peptides.

A RNA transcript, in some embodiments, is the product of an IVT reaction. A RNA transcript, in some embodiments, is a messenger RNA (mRNA) that includes a nucleotide sequence encoding a polypeptide of interest linked to a polyA tail. In some embodiments, the mRNA is modified mRNA (mmRNA), which includes at least one modified nucleotide.

A nucleotide includes a nitrogenous base, a five-carbon sugar (ribose or deoxyribose), and at least one phosphate group. Nucleotides include nucleoside monophosphates, nucleoside diphosphates, and nucleoside triphosphates. A nucleoside monophosphate (NMP) includes a nucleobase linked to a ribose and a single phosphate; a nucleoside diphosphate (NDP) includes a nucleobase linked to a ribose and two phosphates; and a nucleoside triphosphate (NTP) includes a nucleobase linked to a ribose and three phosphates. Nucleotide analogs are compounds that have the general structure of a nucleotide or are structurally similar to a nucleotide. Nucleotide analogs, for example, include an analog of the nucleobase, an analog of the sugar and/or an analog of the phosphate group(s) of a nucleotide.

A nucleoside includes a nitrogenous base and a 5-carbon sugar. Thus, a nucleoside plus a phosphate group yields a nucleotide. Nucleoside analogs are compounds that have the general structure of a nucleoside or are structurally similar to a nucleoside. Nucleoside analogs, for example, include an analog of the nucleobase and/or an analog of the sugar of a nucleoside.

It should be understood that the term "nucleotide" includes naturally-occurring nucleotides, synthetic nucleotides and modified nucleotides, unless indicated otherwise. Examples of naturally-occurring nucleotides used for the production of RNA, e.g., in an IVT reaction, as provided herein include adenosine triphosphate (ATP), guanosine triphosphate (GTP), cytidine triphosphate (CTP), uridine triphosphate (UTP), and 5-methyluridine triphosphate ($m^5$UTP). In some embodiments, adenosine diphosphate (ADP), guanosine diphosphate (GDP), cytidine diphosphate (CDP), and/or uridine diphosphate (UDP) are used.

Examples of nucleotide analogs include, but are not limited to, antiviral nucleotide analogs, phosphate analogs (soluble or immobilized, hydrolyzable or non-hydrolyzable), dinucleotide, trinucleotide, tetranucleotide, e.g., a cap analog, or a precursor/substrate for enzymatic capping (vaccinia or ligase), a nucleotide labeled with a functional group to facilitate ligation/conjugation of cap or 5' moiety (IRES), a nucleotide labeled with a 5' $PO_4$ to facilitate ligation of cap or 5' moiety, or a nucleotide labeled with a functional group/protecting group that can be chemically or enzymatically cleaved. Examples of antiviral nucleotide/nucleoside analogs include, but are not limited to, Ganciclovir, Entecavir, Telbivudine, Vidarabine and Cidofovir.

Modified nucleotides may include modified nucleobases. For example, a RNA transcript (e.g., mRNA transcript) of the present disclosure may include a modified nucleobase selected from pseudouridine (Ψ), 1-methylpseudouridine (m1Ψ), 1-ethylpseudouridine, 2-thiouridine, 4'-thiouridine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methyluridine, 5-methoxyuridine (mo5U) and 2'—O—methyl uridine. In some embodiments, a RNA transcript (e.g., mRNA transcript) includes a combination of at least two (e.g., 2, 3, 4 or more) of the foregoing modified nucleobases.

The nucleoside triphosphates (NTPs) as provided herein may comprise unmodified or modified ATP, modified or unmodified UTP, modified or unmodified GTP, and/or modified or unmodified CTP. In some embodiments, NTPs of an IVT reaction comprise unmodified ATP. In some embodiments, NTPs of an IVT reaction comprise modified ATP. In some embodiments, NTPs of an IVT reaction comprise unmodified UTP. In some embodiments, NTPs of an IVT reaction comprise modified UTP. In some embodiments, NTPs of an IVT reaction comprise unmodified GTP. In some embodiments, NTPs of an IVT reaction comprise modified GTP. In some embodiments, NTPs of an IVT reaction comprise unmodified CTP. In some embodiments, NTPs of an IVT reaction comprise modified CTP.

The concentration of nucleoside triphosphates and cap analog present in an IVT reaction may vary. In some embodiments, NTPs and cap analog are present in the reaction at equimolar concentrations. In some embodiments, the molar ratio of cap analog (e.g., trinucleotide cap) to nucleoside triphosphates in the reaction is greater than 1:1. For example, the molar ratio of cap analog to nucleoside triphosphates in the reaction may be 2:1, 3:1, 4:1, 5:1, 6:1, 7:1, 8:1, 9:1, 10:1, 15:1, 20:1, 25:1, 50:1, or 100:1. In some embodiments, the molar ratio of cap analog (e.g., trinucleotide cap) to nucleoside triphosphates in the reaction is less than 1:1. For example, the molar ratio of cap analog (e.g., trinucleotide cap) to nucleoside triphosphates in the reaction may be 1:2, 1:3, 1:4, 1:5, 1:6, 1:7, 1:8, 1:9, 1:10, 1:15, 1:20, 1:25, 1:50, or 1:100.

The composition of NTPs in an IVT reaction may also vary. For example, ATP may be used in excess of GTP, CTP and UTP. As a non-limiting example, an IVT reaction may include 7.5 millimolar GTP, 7.5 millimolar CTP, 7.5 millimolar UTP, and 3.75 millimolar ATP. The same IVT reaction may include 3.75 millimolar cap analog (e.g., trinucleotide cap). In some embodiments, the molar ratio of G:C:U:A:cap is 1:1:1:0.5:0.5. In some embodiments, the molar ratio of G:C:U:A:cap is 1:1:0.5:1:0.5. In some embodiments, the molar ratio of G:C:U:A:cap is 1:0.5:1:1:0.5. In some embodiments, the molar ratio of G:C:U:A:cap is 0.5:1:1:1:0.5.

In some embodiments, a RNA transcript (e.g., mRNA transcript) includes a modified nucleobase selected from pseudouridine (ψ), 1-methylpseudouridine (m$^1$Ψ), 5-methoxyuridine (mo$^5$U), 5-methylcytidine (m$^5$C), α-thio-guanosine and α-thio-adenosine. In some embodiments, a RNA transcript (e.g., mRNA transcript) includes a combination of at least two (e.g., 2, 3, 4 or more) of the foregoing modified nucleobases.

In some embodiments, a RNA transcript (e.g., mRNA transcript) includes pseudouridine (Ψ). In some embodiments, a RNA transcript (e.g., mRNA transcript) includes 1-methylpseudouridine (m$^1$Ψ). In some embodiments, a RNA transcript (e.g., mRNA transcript) includes 5-methoxyuridine (mo$^5$U). In some embodiments, a RNA transcript (e.g., mRNA transcript) includes 5-methylcytidine (m$^5$C). In some embodiments, a RNA transcript (e.g., mRNA transcript) includes α-thio-guanosine. In some embodiments, a RNA transcript (e.g., mRNA transcript) includes α-thio-adenosine.

In some embodiments, the polynucleotide (e.g., RNA polynucleotide, such as mRNA polynucleotide) is uniformly modified (e.g., fully modified, modified throughout the entire sequence) for a particular modification. For example, a polynucleotide can be uniformly modified with 1-methylpseudouridine (m$^1$Ψ), meaning that all uridine residues in the mRNA sequence are replaced with 1-methylpseudouridine (m$^1$Ψ). Similarly, a polynucleotide can be uniformly modified for any type of nucleoside residue present in the sequence by replacement with a modified residue such as any of those set forth above. Alternatively, the polynucleotide (e.g., RNA polynucleotide, such as mRNA polynucleotide) may not be uniformly modified (e.g., partially modified, part of the sequence is modified). Each possibility represents a separate embodiment of the present invention.

In some embodiments, the buffer system contains tris. The concentration of tris used in an IVT reaction, for example, may be at least 10 mM, at least 20 mM, at least 30 mM, at least 40 mM, at least 50 mM, at least 60 mM, at least 70 mM, at least 80 mM, at least 90 mM, at least 100 mM or at least 110 mM phosphate. In some embodiments, the concentration of phosphate is 20-60 mM or 10-100 mM.

In some embodiments, the buffer system contains dithiothreitol (DTT). The concentration of DTT used in an IVT reaction, for example, may be at least 1 mM, at least 5 mM, or at least 50 mM. In some embodiments, the concentration of DTT used in an IVT reaction is 1-50 mM or 5-50 mM. In some embodiments, the concentration of DTT used in an IVT reaction is 5 mM.

In some embodiments, the buffer system contains magnesium. In some embodiments, the molar ratio of NTP to magnesium ions (Mg$^{2+}$; e.g., MgCl$_2$) present in an IVT reaction is 1:1 to 1:5. For example, the molar ratio of NTP to magnesium ions may be 1:1, 1:2, 1:3, 1:4 or 1:5.

In some embodiments, the molar ratio of NTP plus cap analog (e.g., trinucleotide cap, such as GAG) to magnesium ions (Mg$^{2+}$; e.g., MgCl$_2$) present in an IVT reaction is 1:1 to 1:5. For example, the molar ratio of NTP+trinucleotide cap (e.g., GAG) to magnesium ions may be 1:1, 1:2, 1:3, 1:4 or 1:5.

In some embodiments, the buffer system contains Tris-HCl, spermidine (e.g., at a concentration of 1-30 mM), TRITON® X-100 (polyethylene glycol p-(1,1,3,3-tetramethylbutyl)-phenyl ether) and/or polyethylene glycol (PEG).

The addition of nucleoside triphosphates (NTPs) to the 3' end of a growing RNA strand is catalyzed by a polymerase, such as T7 RNA polymerase, for example, any one or more of the T7 RNA polymerase variants (e.g., G47A) of the present disclosure. In some embodiments, the RNA polymerase (e.g., T7 RNA polymerase variant) is present in a reaction (e.g., an IVT reaction) at a concentration of 0.01 mg/ml to 1 mg/ml. For example, the RNA polymerase may be present in a reaction at a concentration of 0.01 mg/mL, 0.05 mg/ml, 0.1 mg/ml, 0.5 mg/ml or 1.0 mg/ml.

Surprisingly, use of the combination of a T7 RNA polymerase variant (e.g., G47A) as provided herein with a cap analog (e.g., GpppA$_{2'Ome}$pG), in an in vitro transcription reaction, for example, results in the production of RNA transcript, wherein greater than 80% of the RNA transcript produced includes a functional cap. In some embodiments, greater than 85% of the RNA transcript produced includes a functional cap. In some embodiments, greater than 90% of the RNA transcript produced includes a functional cap. In some embodiments, greater than 95% of the RNA transcript produced includes a functional cap. In some embodiments, greater than 96% of the RNA transcript produced includes a functional cap. In some embodiments, greater than 97% of the RNA transcript produced includes a functional cap. In some embodiments, greater than 98% of the RNA transcript produced includes a functional cap. In some embodiments, greater than 99% of the RNA transcript produced includes a functional cap.

Also surprising was the finding that use of a polynucleotide template that includes a 2'-deoxythymidine residue or 2'-deoxycytidine residue at template position+1 results in the production of RNA transcript, wherein greater than 80% (e.g., greater than 85%, greater than 90%, or greater than 95%) of the RNA transcript produced includes a functional cap. Thus, in some embodiments, a polynucleotide (e.g., DNA) template used, for example, in an IVT reaction, includes a 2'-deoxythymidine residue at template position+1. In other embodiments, a polynucleotide (e.g., DNA) template used, for example, in an IVT reaction, includes a 2'-deoxycytidine residue at template position+1.

Multi-Substitution RNA T7 Polymerases Variants

Various aspects of the present disclosure provide RNA T7 polymerase variants that comprise at least two amino acid substitutions. In some embodiments, an RNA T7 polymerase variant comprises at least three amino acid substitutions. In some embodiments, an RNA T7 polymerase variant comprises at least four amino acid substitutions. In some embodiments, an RNA T7 polymerase variant comprises at least five amino acid substitutions. A RNA T7 polymerase variant that includes a G47A substitution, relative to a wild-type T7 RNA polymerase (e.g., comprising the amino acid sequence of SEQ ID NO: 1) may be referred to herein as a "G47A T7 Pol variant."

Table 1 below provides examples of multi-substitution RNA T7 polymerase variants of the present disclosure. It should be understood that each of the T7 polymerase variants included in Table 1 comprises a G47A substitution, relative to a wild-type T7 RNA polymerase that comprises the amino acid sequence of SEQ ID NO: 1. It should also be understood that each of the T7 polymerase variants included in Table 1 comprises an additional C-terminal amino acid at position 884, relative to a wild-type T7 RNA polymerase that comprises the amino acid sequence of SEQ ID NO: 1. This additional C-terminal amino acid is glycine (G884) unless otherwise indicated: G884T denotes a T7 RNA polymerase variant that includes a threonine at position 884 (instead of the glycine); G884S denotes a T7 RNA polymerase variant that includes a serine at position 884 (instead of the glycine); G884P denotes a T7 RNA polymerase variant that includes a proline at position 884 (instead of the glycine); and G884A denotes a T7 RNA polymerase variant that includes an alanine at position 884 (instead of the glycine). All substitutions in Table 1 are relative to a wild-type T7 RNA polymerase variant that comprises the amino acid sequence of SEQ ID NO: 1.

TABLE 1

Multi-Substitution RNA T7 Polymerase Variants

| Substitutions and/or C-terminal Modification | SEQ ID NO: |
|---|---|
| G47A, K387N, G884 | 61 |
| G47A, G884T | 62 |
| G47A, G884T, K387N | 63 |
| G47A, G884S | 64 |
| G47A, G884S, K387N | 65 |
| G47A, G884P | 66 |
| G47A, G884P, K387N | 67 |
| G47A, D653W, G884 | 68 |
| G47A, D653W, K387N, G884 | 69 |
| G47A, D653W, G884T | 70 |
| G47A, D653W, G884T, K387N | 71 |
| G47A, D653W, G884S | 72 |
| G47A, D653W, G884S, K387N | 73 |
| G47A, D653W, G884P | 74 |
| G47A, D653W, G884P, K387N | 75 |
| G47A, D653T, G884 | 76 |
| G47A, D653T, K387N, G884 | 77 |
| G47A, D653T, G884T | 78 |
| G47A, D653T, G884T, K387N | 79 |
| G47A, D653T, G884S | 80 |
| G47A, D653T, G884S, K387N | 81 |
| G47A, D653T, G884P | 82 |
| G47A, D653T, G884P, K387N | 83 |
| G47A, D653K, G884 | 84 |
| G47A, D653K, K387N, G884 | 85 |
| G47A, D653K, G884T | 86 |
| G47A, D653K, G884T, K387N | 87 |
| G47A, D653K, G884S | 88 |
| G47A, D653K, G884S, K387N | 89 |
| G47A, D653K, G884P | 90 |
| G47A, D653K, G884P, K387N | 91 |
| G47A, K387S, G884 | 92 |
| G47A, K387H, G884 | 93 |
| G47A, E350A, G884 | 94 |
| G47A, E350A, K387S, G884 | 95 |
| G47A, E350A, K387H, G884 | 96 |
| G47A, E350A, K387N, G884 | 97 |
| G47A, E350K, G884 | 98 |
| G47A, E350K, K387S, G884 | 99 |
| G47A, E350K, K387H, G884 | 100 |
| G47A, E350K, K387N, G884 | 101 |
| G47A, E350N, G884 | 102 |
| G47A, E350N, K387S, G884 | 103 |
| G47A, E350N, K387H, G884 | 104 |
| G47A, E350N, K387N, G884 | 105 |
| G47A, E350W, G884 | 106 |
| G47A, E350W, K387S, G884 | 107 |
| G47A, E350W, K387H, G884 | 108 |
| G47A, E350W, K387N, G884 | 109 |
| G47A, D351V, G884 | 110 |
| G47A, D351V, K387S, G884 | 111 |
| G47A, D351V, K387H, G884 | 112 |
| G47A, D351V, K387N, G884 | 113 |
| G47A, D351V, E350A, G884 | 114 |
| G47A, D351V, E350A, K387S, G884 | 115 |
| G47A, D351V, E350A, K387H, G884 | 116 |
| G47A, D351V, E350A, K387N, G884 | 117 |
| G47A, D351V, E350K, G884 | 118 |
| G47A, D351V, E350K, K387S, G884 | 119 |
| G47A, D351V, E350K, K387H, G884 | 120 |
| G47A, D351V, E350K, K387N, G884 | 121 |
| G47A, D351V, E350N, G884 | 122 |
| G47A, D351V, E350N, K387S, G884 | 123 |
| G47A, D351V, E350N, K387H, G884 | 124 |
| G47A, D351V, E350N, K387N, G884 | 125 |
| G47A, D351V, E350W, G884 | 126 |
| G47A, D351V, E350W, K387S, G884 | 127 |
| G47A, D351V, E350W, K387H, G884 | 128 |
| G47A, D351V, E350W, K387N, G884 | 129 |
| G47A, D653A, G884 | 130 |

TABLE 1-continued

Multi-Substitution RNA T7 Polymerase Variants

| Substitutions and/or C-terminal Modification | SEQ ID NO: |
|---|---|
| G47A, D653F, G884 | 131 |
| G47A, D653G, G884 | 132 |
| G47A, D653H, G884 | 133 |
| G47A, D653I, G884 | 134 |
| G47A, D653L, G884 | 135 |
| G47A, D653M, G884 | 136 |
| G47A, D653N, G884 | 137 |
| G47A, D653P, G884 | 138 |
| G47A, D653Q, G884 | 139 |
| G47A, D653R, G884 | 140 |
| G47A, D653S, G884 | 141 |
| G47A, D653V, G884 | 142 |
| G47A, D653Y, G884 | 143 |
| G47A, P657W, G884 | 144 |
| G47A, P657R, G884 | 145 |
| G47A, P657A, G884 | 146 |
| G47A, D653W, P657W, G884 | 147 |
| G47A, D653W, P657R, G884 | 148 |
| G47A, D653W, P657A, G884 | 149 |
| G47A, D653T, P657W, G884 | 150 |
| G47A, D653T, P657R, G884 | 151 |
| G47A, D653T, P657A, G884 | 152 |
| G47A, D653K, P657W, G884 | 153 |
| G47A, D653K, P657R, G884 | 154 |
| G47A, D653K, P657A, G884 | 155 |
| G47A, N437T, G884 | 156 |
| G47A, N437Y, G884 | 157 |
| G47A, N437I, G884 | 158 |
| G47A, N437F, G884 | 159 |
| G47A, K441R, G884 | 160 |
| G47A, K441R, N437T, G884 | 161 |
| G47A, K441R, N437Y, G884 | 162 |
| G47A, K441R, N437I, G884 | 163 |
| G47A, K441R, N437F, G884 | 164 |
| G47A, S628W, G884 | 165 |
| G47A, D506W, G884 | 166 |
| G47A, D506W, S628W, G884 | 167 |
| G47A, D506F, G884 | 168 |
| G47A, D506F, S628W, G884 | 169 |
| G47A, D506Y, G884 | 170 |
| G47A, D506Y, S628W, G884 | 171 |
| G47A, D506R, G884 | 172 |
| G47A, D506R, S628W, G884 | 173 |
| G47A, D506L, G884 | 174 |
| G47A, D506L, S628W, G884 | 175 |
| G47A, D653C, G884 | 176 |
| G47A, D653E, G884 | 177 |
| G47A, R632K, G884 | 178 |
| G47A, R632T, G884 | 179 |
| G47A, P657W, R632K, G884 | 180 |
| G47A, P657W, R632T, G884 | 181 |
| G47A, P657R, R632K, G884 | 182 |
| G47A, P657R, R632T, G884 | 183 |
| G47A, P657A, R632K, G884 | 184 |
| G47A, P657A, R632T, G884 | 185 |
| G47A, D653W, R632K, G884 | 186 |
| G47A, D653W, R632T, G884 | 187 |
| G47A, D653W, P657W, R632K, G884 | 188 |
| G47A, D653W, P657W, R632T, G884 | 189 |
| G47A, D653W, P657R, R632K, G884 | 190 |
| G47A, D653W, P657R, R632T, G884 | 191 |
| G47A, D653W, P657A, R632K, G884 | 192 |
| G47A, D653W, P657A, R632T, G884 | 193 |
| G47A, D653F, R632K, G884 | 194 |
| G47A, D653F, R632T, G884 | 195 |
| G47A, D653F, P657W, G884 | 196 |
| G47A, D653F, P657W, R632K, G884 | 197 |
| G47A, D653F, P657W, R632T, G884 | 198 |
| G47A, D653F, P657R, G884 | 199 |
| G47A, D653F, P657R, R632K, G884 | 200 |
| G47A, D653F, P657R, R632T, G884 | 201 |
| G47A, D653F, P657A, G884 | 202 |
| G47A, D653F, P657A, R632K, G884 | 203 |
| G47A, D653F, P657A, R632T, G884 | 204 |
| G47A, D653Y, R632K, G884 | 205 |
| G47A, D653Y, R632T, G884 | 206 |

TABLE 1-continued

Multi-Substitution RNA T7 Polymerase Variants

| Substitutions and/or C-terminal Modification | SEQ ID NO: |
|---|---|
| G47A, D653Y, P657W, G884 | 207 |
| G47A, D653Y, P657W, R632K, G884 | 208 |
| G47A, D653Y, P657W, R632T, G884 | 209 |
| G47A, D653Y, P657R, G884 | 210 |
| G47A, D653Y, P657R, R632K, G884 | 211 |
| G47A, D653Y, P657R, R632T, G884 | 212 |
| G47A, D653Y, P657A, G884 | 213 |
| G47A, D653Y, P657A, R632K, G884 | 214 |
| G47A, D653Y, P657A, R632T, G884 | 215 |
| G47A, D653T, R632K, G884 | 216 |
| G47A, D653T, R632T, G884 | 217 |
| G47A, D653T, P657W, R632K, G884 | 218 |
| G47A, D653T, P657W, R632T, G884 | 219 |
| G47A, D653T, P657R, R632K, G884 | 220 |
| G47A, D653T, P657R, R632T, G884 | 221 |
| G47A, D653T, P657A, R632K, G884 | 222 |
| G47A, D653T, P657A, R632T, G884 | 223 |
| G47A, D653K, R632K, G884 | 224 |
| G47A, D653K, R632T, G884 | 225 |
| G47A, D653K, P657W, R632K, G884 | 226 |
| G47A, D653K, P657W, R632T, G884 | 227 |
| G47A, D653K, P657R, R632K, G884 | 228 |
| G47A, D653K, P657R, R632T, G884 | 229 |
| G47A, D653K, P657A, R632K, G884 | 230 |
| G47A, D653K, P657A, R632T, G884 | 231 |
| G47A, F880Y, G884 | 232 |
| G47A, F880Y, G884S | 233 |
| G47A, F880Y, G884T | 234 |
| G47A, F880Y, G884P | 235 |
| E350W, D351V | 236 |
| E350W, K387N | 237 |
| E350W, D653T | 238 |
| D351V, K387N | 239 |
| D351V, D653T | 240 |
| K387N, D653T | 241 |

Applications

The RNA transcripts produced according to the present disclosure include mRNA (including modified mRNA and/or unmodified RNA), lncRNA, self-replicating RNA, circular RNA, CRISPR guide RNA, and the like. In embodiments, the RNA is RNA (e.g., mRNA or self-replicating RNA) that encodes a polypeptide (e.g., a therapeutic polypeptide). Thus, the RNA transcripts produced using RNA polymerase variants of the present disclosure may be used in a myriad of applications.

For example, the RNA transcripts may be used to produce polypeptides of interest, e.g., therapeutic proteins, vaccine antigen, and the like. In some embodiments, the RNA transcripts are therapeutic RNAs. A therapeutic mRNA is an mRNA that encodes a therapeutic protein (the term 'protein' encompasses peptides). Therapeutic proteins mediate a variety of effects in a host cell or in a subject to treat a disease or ameliorate the signs and symptoms of a disease. For example, a therapeutic protein can replace a protein that is deficient or abnormal, augment the function of an endogenous protein, provide a novel function to a cell (e.g., inhibit or activate an endogenous cellular activity, or act as a delivery agent for another therapeutic compound (e.g., an antibody-drug conjugate). Therapeutic mRNA may be useful for the treatment of the following diseases and conditions: bacterial infections, viral infections, parasitic infections, cell proliferation disorders, genetic disorders, and autoimmune disorders. Other diseases and conditions are encompassed herein.

A protein of interest encoded by an mRNA as provided herein can be essentially any protein. In some embodiments, the therapeutic protein is a cytokine, a growth factor, an antibody or a fusion protein. Non-limiting examples of therapeutic proteins include blood factors (such as Factor VIII and Factor VII), complement factors, Low Density Lipoprotein Receptor (LDLR) and MUT1. Non-limiting examples of cytokines include interleukins, interferons, chemokines, lymphokines and the like. Non-limiting examples of growth factors include erythropoietin, EGFs, PDGFs, FGFs, TGFs, IGFs, TNFs, CSFs, MCSFs, GMCSFs and the like. Non-limiting examples of antibodies include adalimumab, infliximab, rituximab, ipilimumab, tocilizumab, canakinumab, itolizumab, tralokinumab. Non-limiting examples of fusion proteins include, for example, etanercept, abatacept and belatacept.

In some embodiments, the protein of interest is human erythropoietin, LDLR (for use in inhibiting cholesterol), or MUT1 (for use in the treatment of methylmalonic acidemia (MMA)). In other embodiments, the protein of interest encoded by the mRNA is a therapeutic antibody, including but not limited to the antibodies listed above.

A RNA transcript produced using a RNA polymerase variant as disclosed herein may encode one or more biologics. A biologic is a polypeptide-based molecule that may be used to treat, cure, mitigate, prevent, or diagnose a serious or life-threatening disease or medical condition. Biologics include, but are not limited to, allergenic extracts (e.g. for allergy shots and tests), blood components, gene therapy products, human tissue or cellular products used in transplantation, vaccines, monoclonal antibodies, cytokines, growth factors, enzymes, thrombolytics, and immunomodulators, among others.

One or more biologics currently being marketed or in development may be encoded by the RNA of the present invention. While not wishing to be bound by theory, it is believed that incorporation of the encoding polynucleotides of a known biologic into the RNA of the present disclosure will result in improved therapeutic efficacy due at least in part to the specificity, purity and/or selectivity of the construct designs.

A RNA transcript produced using a RNA polymerase variant as disclosed herein may encode one or more antibodies. The term "antibody" includes monoclonal antibodies (including full length antibodies which have an immunoglobulin Fc region), antibody compositions with polyepitopic specificity, multispecific antibodies (e.g., bispecific antibodies, diabodies, and single-chain molecules), as well as antibody fragments. The term "immunoglobulin" (Ig) is used interchangeably with "antibody" herein. A monoclonal antibody is an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site.

Monoclonal antibodies specifically include chimeric antibodies (immunoglobulins) in which a portion of the heavy and/or light chain is identical with or homologous to corresponding sequences in antibodies derived from a particular species or belonging to a particular antibody class or subclass, while the remainder of the chain(s) is(are) identical with or homologous to corresponding sequences in antibodies derived from another species or belonging to another antibody class or subclass, as well as fragments of such antibodies, so long as they exhibit the desired biological activity. Chimeric antibodies include, but are not limited to, "primatized" antibodies comprising variable domain antigen-binding sequences derived from a non-human primate (e.g., Old World Monkey, Ape etc.) and human constant region sequences.

Antibodies encoded in the RNA of the present disclosure may be utilized to treat conditions or diseases in many therapeutic areas such as, but not limited to, blood, cardiovascular, CNS, poisoning (including antivenoms), dermatology, endocrinology, gastrointestinal, medical imaging, musculoskeletal, oncology, immunology, respiratory, sensory and anti-infective.

A RNA transcript produced using a RNA polymerase variant as disclosed herein may encode one or more vaccine antigens. A vaccine antigen is a biological preparation that improves immunity to a particular disease or infectious agent. One or more vaccine antigens currently being marketed or in development may be encoded by the RNA of the present disclosure. Vaccine antigens encoded in the RNA may be utilized to treat conditions or diseases in many therapeutic areas such as, but not limited to, cancer, allergy and infectious disease. In some embodiments, a cancer vaccine may be a personalized cancer vaccine in the form of a concatemer or individual RNAs encoding peptide epitopes or a combination thereof.

A RNA transcript produced using a RNA polymerase variant as disclosed herein may be designed to encode on or more antimicrobial peptides (AMP) or antiviral peptides (AVP). AMPs and AVPs have been isolated and described from a wide range of animals such as, but not limited to, microorganisms, invertebrates, plants, amphibians, birds, fish, and mammals. The anti-microbial polypeptides may block cell fusion and/or viral entry by one or more enveloped viruses (e.g., HIV, HCV). For example, the anti-microbial polypeptide can comprise or consist of a synthetic peptide corresponding to a region, e.g., a consecutive sequence of at least about 5, 10, 15, 20, 25, 30, 35, 40, 45, 50, 55, or 60 amino acids of the transmembrane subunit of a viral envelope protein, e.g., HIV-1 gp120 or gp41. The amino acid and nucleotide sequences of HIV-1 gp120 or gp41 are described in, e.g., Kuiken et al., (2008). "HIV Sequence Compendium," Los Alamos National Laboratory.

In some embodiments, RNA transcripts are used as radiolabeled RNA probes. In some embodiments, RNA transcripts are used for non-isotopic RNA labeling. In some embodiments, RNA transcripts are used as guide RNA (gRNA) for gene targeting. In some embodiments, RNA transcripts (e.g., mRNA) are used for in vitro translation and micro injection. In some embodiments, RNA transcripts are used for RNA structure, processing and catalysis studies. In some embodiments, RNA transcripts are used for RNA amplification. In some embodiments, RNA transcripts are used as anti-sense RNA for gene expression experiment. Other applications are encompassed by the present disclosure.

Additional Embodiments

Additional embodiments of the present disclosure are encompassed by the following numbered paragraphs:
1. A ribonucleic acid (RNA) polymerase variant comprising a RNA polymerase that comprises:
 (a) an amino acid substitution at a binding site residue for de novo RNA synthesis; and
 (b) an amino acid modification that causes increased transcription efficiency, relative to wild-type RNA polymerase.
2. The RNA polymerase variant of paragraph 1, wherein the amino acid modification causes a loop structure of the RNA polymerase variant to undergo a conformational change to a helix structure as the RNA polymerase variant transitions from an initiation complex to an elongation complex.
3. The RNA polymerase variant of paragraph 2, wherein the amino acid modification is an amino acid substitution at position 47, relative to the wild-type RNA polymerase, wherein the wild-type RNA polymerase comprises the amino acid sequence of SEQ ID NO: 1.
4. The RNA polymerase variant of paragraph 3, wherein the amino acid substitution at position 47 is G47A.
5. The RNA polymerase variant of any one of paragraphs 1-4, wherein the amino acid modification comprises an additional C-terminal amino acid, relative to the wild-type RNA polymerase.
6. The RNA polymerase variant of paragraph 5, wherein the additional C-terminal amino acid is glycine.
7. The RNA polymerase variant of any one of paragraphs 1-6, wherein the amino acid substitution at a binding site residue causes at least one of the following benefits, relative to the wild-type RNA polymerase:
 (i) increased transcription efficiency,
 (ii) increased co-transcriptional capping efficiency;
 (iii) increased yield of RNA at ½ concentration of a cap analog;
 (iv) improved 3' homogeneity of RNA at ½ concentration of a cap analog;
 (v) improved fidelity of transcription; and/or
 (vi) lower amount of dsRNA contamination.
8. The polymerase variant of any one of paragraphs 1-6, wherein the amino acid substitution at a binding site residue causes at least one of the following benefits, relative to the amino acid modification of (b):
 (i) increased transcription efficiency,
 (ii) increased co-transcriptional capping efficiency;
 (iii) increased yield of RNA at ½ concentration of a cap analog;
 (iv) improved 3' homogeneity of RNA at ½ concentration of a cap analog;
 (v) improved fidelity of transcription; and/or
 (vi) lower amount of dsRNA contamination.
9. The RNA polymerase variant of any one of paragraphs 1-8, wherein the amino acid substitution at the binding site residue is a substitution at a position selected from positions 350, 351, 387, 394, 425, 427, 437, 441, 506, 628, 632, 653, 657, 811, and 880, relative to the wild-type RNA polymerase, wherein the wild-type RNA polymerase comprises the amino acid sequence of SEQ ID NO: 1.
10. A RNA polymerase variant comprising a RNA polymerase that comprises:
 (a) an amino acid substitution at a position selected from positions 350, 351, 387, 394, 425, 427, 437, 441, 506, 628, 632, 653, 657, 811, and 880; and
 (b) an additional amino acid substitution and/or an amino acid modification at the C-terminal end, relative to wild-type RNA polymerase, wherein the wild-type RNA polymerase comprises the amino acid sequence of SEQ ID NO: 1.
11. The RNA polymerase variant of paragraph 10 comprising the additional amino acid substitution of (b).
12. The RNA polymerase variant of paragraph 11, wherein the additional amino acid substitution of (b) is at position 47.
13. The RNA polymerase variant of paragraph 12, wherein the additional amino acid substitution at position 47 is G47A.

14. The RNA polymerase variant of any one of paragraphs 10-13 comprising the amino acid modification at the C-terminal end.
15. The RNA polymerase variant of paragraph 14, wherein the amino acid modification at the C-terminal end comprises an additional C-terminal amino acid.
16. The RNA polymerase variant of paragraph 15, wherein the additional C-terminal amino acid is selected from glycine, serine, alanine, proline, and threonine.
17. The RNA polymerase variant of paragraph 16, wherein the additional C-terminal amino acid is glycine.
18. The RNA polymerase variant of paragraph 16, wherein the additional C-terminal amino acid is alanine.
19. The RNA polymerase variant of paragraph 17 or 18 comprising a RNA polymerase that comprises (a) an amino acid substitution at a position selected from positions 350, 351, 387, 394, 425, 427, 437, 441, 506, 628, 632, 653, 657, 811, and 880;
(b) an additional amino acid substitution; and
(c) an amino acid modification at the C-terminal end, relative to a wild-type RNA polymerase, wherein the wild-type RNA polymerase comprises the amino acid sequence of SEQ ID NO: 1.

20. The RNA polymerase variant of paragraph 19, wherein the additional amino acid substitution is at position 47.
21. The RNA polymerase variant of paragraph 20, wherein the additional amino acid substitution at position 47 is G47A.
22. The RNA polymerase variant of any one of paragraphs 19-21, wherein the amino acid modification at the C-terminal end comprises an additional C-terminal amino acid.
23. The RNA polymerase variant of paragraph 22, wherein the additional C-terminal amino acid is selected from glycine, serine, alanine, proline, glutamine, and threonine.
24. The RNA polymerase variant of paragraph 23, wherein the additional C-terminal amino acid is glycine.
25. The RNA polymerase variant of any one of paragraphs 1-24, wherein the additional amino acid substitution of (a) is at a position selected from position 387, 350, 351, 506, 628, 653, and 657, relative to the wild-type RNA polymerase, wherein the wild-type RNA polymerase comprises the amino acid sequence of SEQ ID NO: 1.
26. The RNA polymerase variant of paragraph 25, wherein the additional amino acid substitution is selected from K387S, K387H, and K387N.
27. The RNA polymerase variant of paragraph 25, wherein the additional amino acid substitution is selected from E350K, E350N, E350A, and E350W.
28. The RNA polymerase variant of paragraph 25, wherein the additional amino acid substitution is D351V.
29. The RNA polymerase variant of paragraph 25, wherein the additional amino acid substitution is D506W.
30. The RNA polymerase variant of paragraph 25, wherein the additional amino acid substitution is S628W.
31. The RNA polymerase variant of paragraph 25, wherein the additional amino acid substitution is D653W.
32. The RNA polymerase variant of paragraph 25, wherein the additional amino acid substitution is P657W.
33. The RNA polymerase variant of any one of paragraphs 1-24, wherein the additional amino acid substitution of (a) is at a position selected from position 350, 351, 387, and 437, relative to the wild-type RNA polymerase, wherein the wild-type RNA polymerase comprises the amino acid sequence of SEQ ID NO: 1.
34. The RNA polymerase variant of paragraph 33, wherein the additional amino acid substitution of (a) is at position 350, and the additional amino acid substitution at position 350 is selected from E350R, E350K, E350D, E350Q, E350N, E350T, E350S, E350C, E350G, E350A, E350V, E350L, E350I, E350P, E350Y, E350W, and E350F.
35. The RNA polymerase variant of paragraph 33, wherein the additional amino acid substitution of (a) is at position 351, and the additional amino acid substitution at position 350 is selected from D351R, D351K, D351Q, D351T, D351S, D351C, D351V, D351L, D351I, D351M, D351P, D351Y, and D351W.
36. The RNA polymerase variant of paragraph 33, wherein the additional amino acid substitution of (a) is at position 387, and the additional amino acid substitution at position 387 is selected from K387R, K387H, K387T, K387S, K387V, K387L, K387I, and K387M.
37. The RNA polymerase variant of paragraph 33, wherein the additional amino acid substitution of (a) is at position 437, and the additional amino acid substitution at position 437 is selected from N437Q, N437T, N437S, N437G, and N437F.
38. The RNA polymerase variant of paragraph 22, wherein the additional C-terminal amino acid is serine or alanine.
39. The RNA polymerase variant of paragraph 33, wherein the additional amino acid substitution of (a) is at position 350, and the additional amino acid substitution at position 350 is selected from E350N, E350C, E350G, E350Y, E350W, and E350F.
40. The RNA polymerase variant of paragraph 33, wherein the additional amino acid substitution of (a) is at position 351, and the additional amino acid substitution at position 351 is selected from D351R, D351S, D351L, D351M, and D351Y.
41. The RNA polymerase variant of paragraph 33, wherein the additional amino acid substitution of (a) is at position 387, and the additional amino acid substitution at position 387 is selected from K387R, K387T, K387L, and K387M.
42. The RNA polymerase variant of paragraph 33, wherein the additional amino acid substitution of (a) is at position 437, and the additional amino acid substitution at position 437 is selected from N437R, N437K, N437H, N437T, N437V, N437I, and N437W.
43. The RNA polymerase variant of paragraph 22, wherein the additional C-terminal amino acid is glutamine, threonine, or proline.
44. The RNA polymerase variant of any one of paragraphs 1-24, wherein the additional amino acid substitution of (a) is at a position selected from position 350, 351, 387, 437, 441, 632, and 880, relative to the wild-type RNA polymerase, wherein the wild-type RNA polymerase comprises the amino acid sequence of SEQ ID NO: 1.
45. The RNA polymerase variant of paragraph 44, wherein the additional amino acid substitution of (a) is at position 350, and the additional amino acid substitution at position 350 is selected from E350R, E350K, E350D, E350Q, E350N, E350T, E350S, E350C, E350G, E350A, E350V, E350L, E350I, E350Y, E350W, and E350F.

46. The RNA polymerase variant of paragraph 44, wherein the additional amino acid substitution of (a) is at position 351, and the additional amino acid substitution at position 351 is selected from D351R, D351K, D351Q, D351T, D351C, D351V, D351L, D351M, and D351W.

47. The RNA polymerase variant of paragraph 44, wherein the additional amino acid substitution of (a) is at position 387, and the additional amino acid substitution at position 387 is selected from K387H, K387E, K387N, K387T, K387S, K387G, K387A, K387Y, K387W, and K387F.

48. The RNA polymerase variant of paragraph 44, wherein the additional amino acid substitution of (a) is at position 437, and the additional amino acid substitution at position 437 is selected from N437T, N437I, N437Y, N437W, and N437F.

49. The RNA polymerase variant of paragraph 44, wherein the additional amino acid substitution of (a) is at position 444, and the additional amino acid substitution at position 444 is K444R.

50. The RNA polymerase variant of paragraph 44, wherein the additional amino acid substitution of (a) is at position 632, and the additional amino acid substitution at position 632 is selected from R632K and R632T.

51. The RNA polymerase variant of paragraph 44, wherein the additional amino acid substitution of (a) is at position 880, and the additional amino acid substitution at position 880 is F880Y.

52. The RNA polymerase variant of paragraph 22, wherein the additional C-terminal amino acid is glutamine, threonine, and proline.

53. The RNA polymerase variant of paragraph 44, wherein the additional amino acid substitution of (a) is at position 350, and the additional amino acid substitution at position 350 is selected from E350K, E350N, E350A, and E350W.

54. The RNA polymerase variant of paragraph 44, wherein the additional amino acid substitution of (a) is at position 351, and the additional amino acid substitution at position 351 is D351V.

55. The RNA polymerase variant of paragraph 44, wherein the additional amino acid substitution of (a) is at position 387, and the additional amino acid substitution at position 387 is selected from K387H, K387N, and K387S.

56. The RNA polymerase variant of paragraph 44, wherein the additional amino acid substitution of (a) is at position 437, and the additional amino acid substitution at position 437 is selected from N437T, N437I, N437Y, and N437F.

57. The RNA polymerase variant of paragraph 44, wherein the additional amino acid substitution of (a) is at position 444, and the additional amino acid substitution at position 444 is selected from K444R.

58. The RNA polymerase variant of paragraph 44, wherein the additional amino acid substitution of (a) is at position 880, and the additional amino acid substitution at position 880 is F880Y.

59. The RNA polymerase variant of paragraph 22, wherein the additional C-terminal amino acid is threonine, serine, alanine, and proline.

60. A RNA polymerase variant comprising a RNA polymerase that comprises:
(a) an amino acid substitution at positions 350, 351, and 387; and
(b) an additional amino acid substitution and/or an amino acid modification at the C-terminal end, relative to wild-type RNA polymerase, wherein the wild-type RNA polymerase comprises the amino acid sequence of SEQ ID NO: 1.

61. The RNA polymerase variant of paragraph 60, wherein:
the additional amino acid substitution at position 350 is selected from E350A, E350K, E350N, and E350W;
the additional amino acid substitution at position 351 is D351V; and/or
the additional amino acid substitution at position 387 is selected from K387S, K387H, and K387N.

62. A RNA polymerase variant comprising a RNA polymerase that comprises:
(a) an amino acid substitution at positions 437 and 441; and
(b) an additional amino acid substitution and/or an amino acid modification at the C-terminal end, relative to wild-type RNA polymerase, wherein the wild-type RNA polymerase comprises the amino acid sequence of SEQ ID NO: 1.

63. The RNA polymerase variant of paragraph 62, wherein:
the additional amino acid substitution at position 437 is selected from N437T, N437Y, N437I, and N437F; and/or
the additional amino acid substitution at position 441 is K441R.

64. A RNA polymerase variant comprising a RNA polymerase that comprises:
(a) an amino acid substitution at positions 880; and
(b) an amino acid modification at the C-terminal end, relative to wild-type RNA polymerase, wherein the wild-type RNA polymerase comprises the amino acid sequence of SEQ ID NO: 1.

65. The RNA polymerase variant of paragraph 64, wherein:
the additional amino acid substitution at position 880 is F880Y; and/or
the amino acid modification at the C-terminal end is an additional amino acid selected from alanine, serine, threonine, and proline.

66. A RNA polymerase variant comprising a RNA polymerase that comprises:
(a) an amino acid substitution at positions 632, 653, and 657; and
(b) an additional amino acid substitution and/or an amino acid modification at the C-terminal end, relative to wild-type RNA polymerase, wherein the wild-type RNA polymerase comprises the amino acid sequence of SEQ ID NO: 1.

67. The RNA polymerase variant of paragraph 66, wherein:
the additional amino acid substitution at position 632 is selected from R632K and R632T;
the additional amino acid substitution at position 653 is selected from D653T and D653K; and/or.
the additional amino acid substitution at position 657 is selected from P657W, P657R, or P657A.

68. The RNA polymerase variant of any one of paragraphs 60-67 comprising the additional amino acid substitution of (b).

69. The RNA polymerase variant of paragraph 68, wherein the additional amino acid substitution of (b) is at position 47.
70. The RNA polymerase variant of paragraph 69, wherein the additional amino acid substitution of (b) at position 47 is G47A.
71. The RNA polymerase variant of any one of paragraphs 60-70 comprising the amino acid modification at the C-terminal end.
72. The RNA polymerase variant of paragraph 71, wherein the amino acid modification at the C-terminal end comprises an additional C-terminal amino acid.
73. The RNA polymerase variant of paragraph 72, wherein the additional C-terminal amino acid is glycine.
74. The RNA polymerase variant of any one of paragraphs 1-73 comprising an amino acid sequence having at least 90% identity to the wild-type RNA polymerase, wherein the wild-type RNA polymerase comprises the amino acid sequence of SEQ ID NO: 1.
75. A method comprising producing a ribonucleic acid (RNA) transcript in an in vitro transcription reaction that comprises a polynucleotide template, nucleoside triphosphates, a cap analog, and a RNA polymerase comprising at least one mutation relative to a wild-type RNA polymerase, wherein the reaction comprises a concentration of the cap analog that is at least 5-fold lower than a concentration of the cap analog required to produce an equivalent amount of RNA transcript using wild-type RNA polymerase, optionally wherein the wild-type RNA polymerase is wild-type T7 RNA polymerase.
76. The method of paragraph 75, wherein greater than 80% of the RNA transcript produced includes a functional cap.
77. The method of paragraph 75 or 76, wherein the RNA transcript produced has greater than a threshold 3' homogeneity, wherein the threshold 3' homogeneity is at least 50% 3' homogeneity.
78. The method of any one of paragraph 75-77, wherein the RNA transcript produced has lower than a threshold quantity of dsRNA, wherein the threshold quantity of dsRNA is 5 ng dsRNA per 25 µg of mRNA.
79. A method comprising producing a RNA transcript in an in vitro transcription reaction that comprises a polynucleotide template, nucleoside triphosphates, and the RNA polymerase variant of any one of paragraphs 1-74.
80. A method comprising producing a RNA transcript in an in vitro transcription reaction that comprises a polynucleotide template, nucleoside triphosphates, a cap analog, and the RNA polymerase variant of any one of paragraphs 1-72.
81. The method of paragraph 79 or 80, wherein the nucleoside triphosphates comprise unmodified or modified ATP, modified or unmodified UTP, modified or unmodified GTP, and/or modified or unmodified CTP.
82. The method of paragraph 80 or 81, wherein the reaction comprises a concentration of the cap analog that is at least 2-fold lower, at least 5-fold lower, or at least 10-fold lower than a concentration of the cap analog required to produce an equivalent amount of RNA transcript using the wild-type RNA polymerase.
83. The method of any one of paragraphs 80-82, wherein greater than 80%, greater than 85%, greater than 90%, or greater than 95% of the RNA transcript produced includes a functional cap.
84. The method of any one of paragraphs 80-83, wherein the nucleoside triphosphates and cap analog are present in the reaction at equimolar concentrations.
85. The method of any one of paragraphs 80-84, wherein a molar ratio of cap analog to nucleoside triphosphates in the reaction is greater than 1:1 or equal to 1:1.
86. The method of any one of paragraphs 80-85, wherein the cap analog is a dinucleotide cap, a trinucleotide cap, or a tetranucleotide cap.
87. The method of any one of paragraphs 80-86, wherein the cap analog is a natural cap analog or a synthetic cap analog.
88. The method of paragraph 86 or 87, wherein the cap analog is a trinucleotide cap comprising a sequence selected from the following sequences: GAA, GAC, GAG, GAU, GCA, GCC, GCG, GCU, GGA, GGC, GGG, GGU, GUA, GUC, GUG, and GUU.
89. The method of paragraph 88, wherein the trinucleotide cap comprises a sequence selected from the following sequences: GAG, GCG, GUG, and GGG.
90. The method of paragraph 89, wherein the trinucleotide cap comprises sequence GAG.
91. The method of paragraph 90, wherein the trinucleotide cap comprises a sequence selected from the following sequences:
(a) $m^7$GpppApA, $m^7$GpppApC, $m^7$GpppApG, $m^7$GpppApU, $m^7$GpppCpA, $m^7$GpppCpC, $m^7$GpppCpG, $m^7$GpppCpU, $m^7$GpppGpA, $m^7$GpppGpC, $m^7$GpppGpG, $m^7$GpppGpU, $m^7$GpppUpA, $m^7$GpppUpC, $m^7$GpppUpG, and $m^7$GpppUpU;
(b) $m^7G_{3'OMe}$pppApA, $m^7G_{3'OMe}$pppApC, $m^7G_{3'OMe}$pppApG, $m^7G_{3'OMe}$pppApU, $m^7G_{3'OMe}$pppCpA, $m^7G_{3'OMe}$pppCpC, $m^7G_{3'OMe}$pppCpG, $m^7G_{3'OMe}$pppCpU, $m^7G_{3'OMe}$pppGpA, $m^7G_{3'OMe}$pppGpC, $m^7G_{3'OMe}$pppGpG, $m^7G_{3'OMe}$pppGpU, $m^7G_{3'OMe}$pppUpA, $m^7G_{3'OMe}$pppUpC, $m^7G_{3'OMe}$pppUpG, and $m^7G_{3'OMe}$pppUpU;
(c) $m^7G_{3'OMe}$pppA$_{2'OMe}$pA, $m^7G_{3'OMe}$pppA$_{2'OMe}$pC, $m^7G_{3'OMe}$pppA$_{2'OMe}$pG, $m^7G_{3'OMe}$pppA$_{2'OMe}$pU, $m^7G_{3'OMe}$pppC$_{2'OMe}$pA, $m^7G_{3'OMe}$pppC$_{2'OMe}$pC, $m^7G_{3'OMe}$pppC$_{2'OMe}$pG, $m^7G_{3'OMe}$pppC$_{2'OMe}$pU, $m^7G_{3'OMe}$pppG$_{2'OMe}$pA, $m^7G_{3'OMe}$pppG$_{2'OMe}$pC, $m^7G_{3'OMe}$pppG$_{2'OMe}$pG, $m^7G_{3'OMe}$pppG$_{2'OMe}$pU, $m^7G_{3'OMe}$pppU$_{2'OMe}$pA, $m^7G_{3'OMe}$pppU$_{2'OMe}$pC, $m^7G_{3'OMe}$pppU$_{2'OMe}$pG, and $m^7G_{3'OMe}$pppU$_{2'OMe}$pU; or
(d) $m^7$GpppA$_{2'OMe}$pA, $m^7$GpppA$_{2'OMe}$pC, $m^7$GpppA$_{2'OMe}$pG, $m^7$GpppA$_{2'OMe}$pU, $m^7$GpppC$_{2'OMe}$pA, $m^7$GpppC$_{2'OMe}$pC, $m^7$GpppC$_{2'OMe}$pG, $m^7$GpppC$_{2'OMe}$pU, $m^7$GpppG$_{2'OMe}$pA, $m^7$GpppG$_{2'OMe}$pC, $m^7$GpppG$_{2'OMe}$pG, $m^7$GpppG$_{2'OMe}$pU, $m^7$GpppU$_{2'OMe}$pA, $m^7$GpppU$_{2'OMe}$pC, $m^7$GpppU$_{2'OMe}$pG, and $m^7$GpppU$_{2'OMe}$pU. 92. The method of paragraph 91, wherein the trinucleotide cap comprises GpppA$_{2'Ome}$pG.
93. The method of any one of paragraphs 75-92, wherein the polynucleotide template includes a 2'-deoxythymidine residue or a 2'-deoxycytidine residue at template position+1.

94. The method of any one of paragraphs 75-93, wherein the RNA transcript produced, when delivered to cells, optionally in unpurified form, stimulates a cytokine response that is at least 50% lower relative to RNA produced using wild-type RNA polymerase.

95. The method of any one of paragraphs 75-94, wherein the concentration of double-stranded RNA (dsRNA) transcript produced is at least 50% lower relative to dsRNA transcript produced using wild-type RNA polymerase.

96. The method of any one of paragraphs 75-95, wherein less than 50%, less than 25%, or less than 10% of the RNA transcript produced is dsRNA.

97. The method of any one of paragraphs 75-96, wherein less than 30% or less than 20% of the RNA transcripts produced exhibit 3' heterogeneity.

98. The method of any one of paragraphs 75-97, wherein less than 50%, less than 25%, or less than 10% of the RNA transcript produced is run-on RNA transcript.

99. The method of any one of paragraphs 75-98, wherein the amount of full-length RNA transcript produced is at least 15 times greater than the amount of the polynucleotide template.

100. The method of any one of paragraphs 75-99, wherein the ratio of dsRNA:full-length RNA transcript produced is less than 1:1.

101. The method of any one of paragraphs 75-100, wherein the RNA transcript produced has less than 1 mutation per 100 nucleotides relative to the polynucleotide template.

102. A nucleic acid encoding the RNA polymerase variant of any one of paragraphs 1-74.

103. A composition comprising the RNA polymerase variant of any one of paragraphs 1-74 and optionally nucleoside triphosphates.

104. A kit comprising the RNA polymerase variant of any one of paragraphs 1-74 and an in vitro transcription (IVT) reagent.

105. A ribonucleic acid (RNA), optionally a messenger RNA (mRNA), produced by the method of any one of paragraphs 75-104.

106. A lipid nanoparticle comprising the RNA of paragraph 103, optionally wherein the lipid nanoparticle comprises a molar ratio of 20-60% ionizable amino lipid, 5-25% non-cationic lipid, 25-55% sterol, and 0.5-15% PEG-modified lipid.

107. A RNA polymerase variant derived from a starting RNA polymerase that has an amino acid modification at position G47 and an additional C-terminal amino acid relative to a wild type amino acid sequence of T7 RNA polymerase comprising the sequence of SEQ ID NO: 1, wherein the variant comprises at least one substitution that affects first nucleotide binding to the D-site within the RNA polymerase variant as it is in the conformational state for de novo initiation of RNA synthesis, and wherein the amino acid substitution causes at least one of the following benefits relative to the starting RNA polymerase:
(i) increased transcription efficiency,
(ii) increased co-transcriptional capping efficiency;
(iii) increased yield of RNA;
(iv) improved 3' homogeneity of RNA transcripts;
(v) improved fidelity of transcription; and
(vi) lower amounts of dsRNA in the reaction mixture.

108. A RNA polymerase variant comprising the amino acid sequence of any one of SEQ ID NOS: 3-14, 45-48, or 242-247, wherein X is any amino acid selected from R, K, H, E, D, Q, N, T, S, C, G, A, V, L, I, M, P, Y, W, and F.

109. The RNA polymerase of paragraph 108 comprising the amino acid sequence of SEQ ID NO: 47.

110. The RNA polymerase of paragraph 109, wherein X is W.

111. The RNA polymerase variant of any one of paragraphs 108-110 further comprising a G47A substitution.

112. The RNA polymerase variant of any one of paragraphs 108-111 further comprising an additional C-terminal amino acid.

113. The RNA polymerase variant of paragraph 112, wherein the additional C-terminal amino acid is glycine.

114. A RNA polymerase variant comprising the amino acid sequence of any one of SEQ ID NOS: 61-241.

115. A nucleic acid encoding the RNA polymerase variant of paragraph 114.

116. A method comprising producing a RNA transcript in an in vitro transcription reaction that comprises a polynucleotide template, nucleoside triphosphates, and the RNA polymerase variant of paragraph 114.

117. A method comprising producing a RNA transcript in an in vitro transcription reaction that comprises a polynucleotide template, nucleoside triphosphates, a cap analog, and the RNA polymerase variant of paragraph 114.

118. A RNA polymerase variant comprising a RNA polymerase that comprises:
(a) an amino acid substitution at position E350, K387, N437, F880, or D653;
(b) an amino acid substitution at position G47; and/or
(c) an amino acid modification at the C-terminal end, relative to a wild-type RNA polymerase comprising the amino acid sequence of SEQ ID NO: 1.

119. The RNA polymerase of paragraph 118, wherein the amino acid substitution of (a) is selected from the group consisting of E350N, K387N, N437F, F880Y, and D653W.

120. The RNA polymerase variant of paragraph 119, wherein the amino acid substitution of (a) is D653W.

121. The RNA polymerase variant of any one of paragraphs 118-120, wherein the amino acid substitution at position G47 is G47A.

122. The RNA polymerase variant of any one of paragraphs 118-121, wherein the amino acid modification at the C-terminal end is an additional glycine, an additional alanine, an additional threonine, or an additional proline.

123. A RNA polymerase variant comprising a RNA polymerase that comprises amino acid substitution at two of the positions selected from the group consisting of E350, D351, K387, N437, K441, D506, R632, D653, S628, P657, and F880, relative to a wild-type RNA polymerase comprising the amino acid sequence of SEQ ID NO: 1.

124. The RNA polymerase variant of paragraph 123 comprising amino acid substiutions at E350 and D351.

125. The RNA polymerase variant of paragraph 123 comprising amino acid substiutions at E350 and K387.

126. The RNA polymerase variant of paragraph 123 comprising amino acid substiutions at K387 and D653.

127. The RNA polymerase variant of any one of paragraphs 123-125, wherein the amino acid substitution at position E350 is E350W, E350A, E350K, or E350N.

128. The RNA polymerase variant of paragraph 123 or 124, wherein the amino acid substitution at position D351 is D351V.
129. The RNA polymerase variant of any one of paragraphs 123, 125, or 126, wherein the amino acid substitution at position K387 is K387N, K387S, or K387H.
130. The RNA polymerase variant of paragraph 123 or 126, wherein the amino acid substitution at position D653 is D653T or D653K.
131. A method comprising producing a RNA transcript in an in vitro transcription reaction that comprises a polynucleotide template, nucleoside triphosphates, a cap analog, and the RNA polymerase variant of any one of the preceding paragraphs, wherein the cap analog is a trinucleotide cap analog or a tetranucleotide cap analog.
132. The method of any one of the preceding paragraphs, wherein the cap analog is a trinucleotide cap analog that comprises GAG.
133. The method of paragraph 132, wherein the GAG cap analog is selected from:

(i)
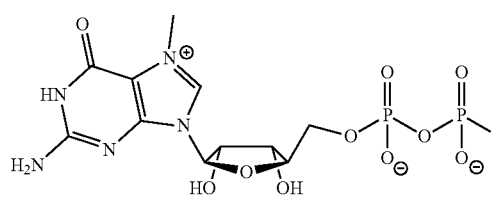
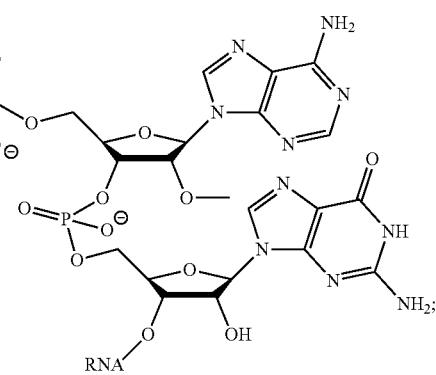

(ii)
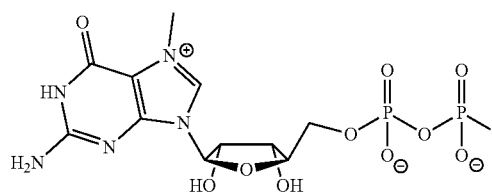
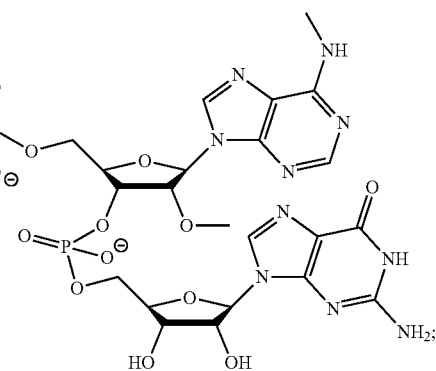
or (iii)
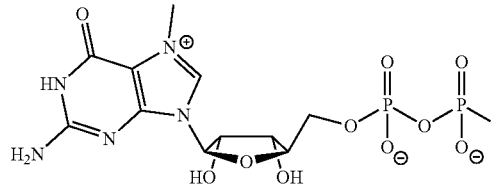
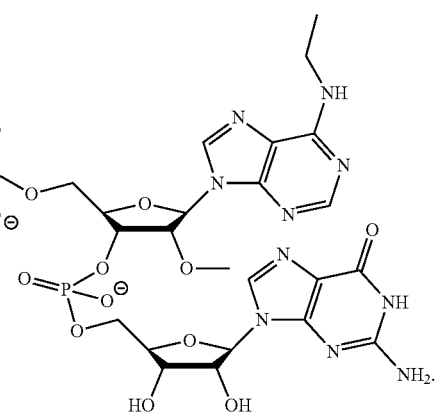

134. The method of any one of the preceding paragraphs, wherein the cap analog is a tetranucleotide cap analog that comprises GGAG.
135. The method of paragraph 134, wherein the tetranucleotide cap analog is selected from:
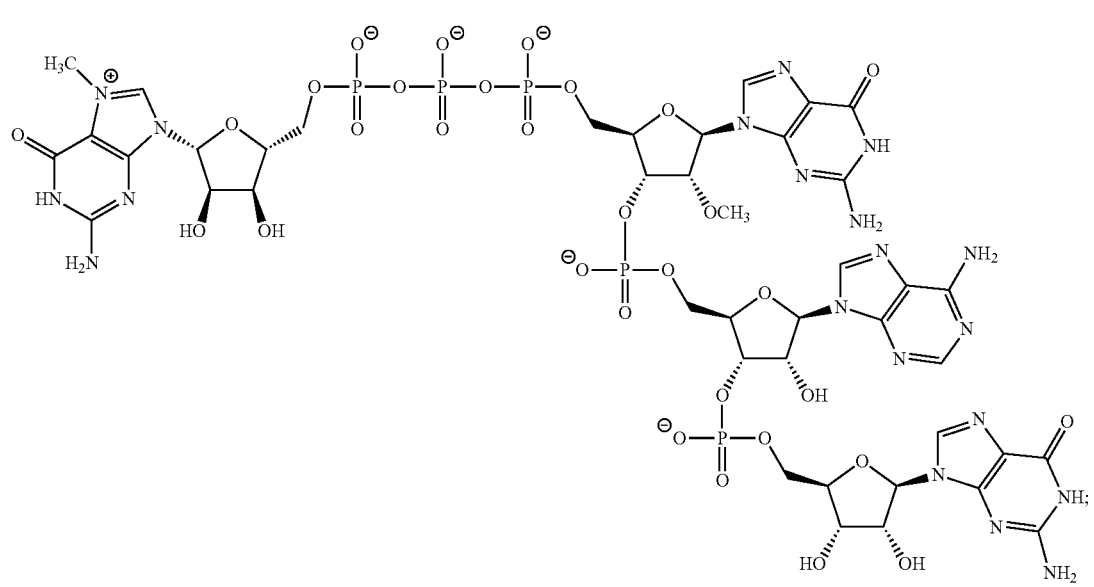
(iv)
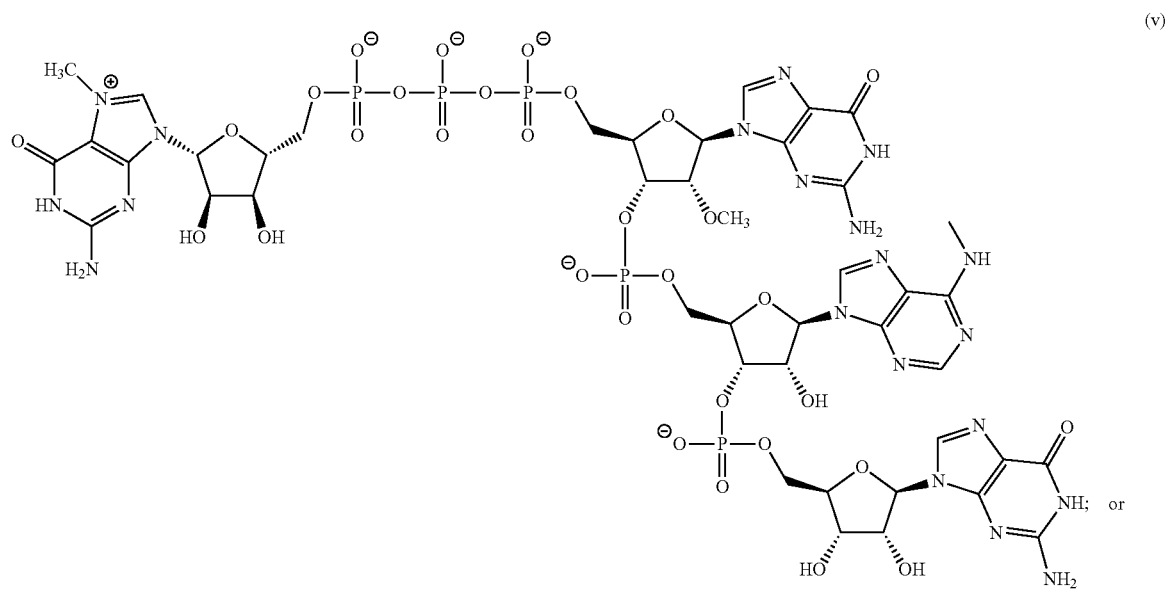
(v)
or

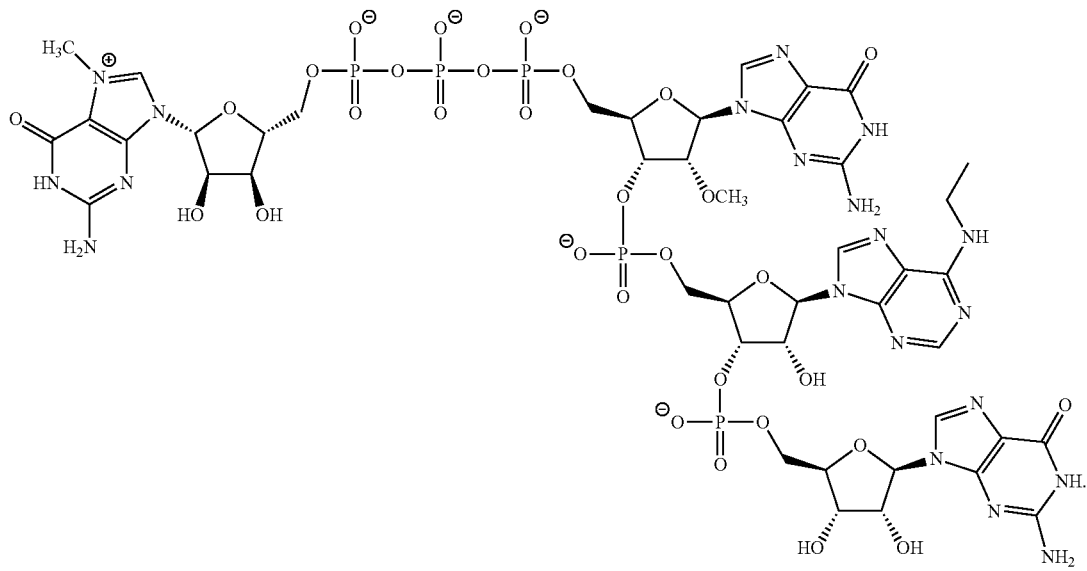

(vi)

-continued

136. The method of any one of the preceding paragraphs, wherein greater than 80%, greater than 85%, greater than 90%, or greater than 95% of the RNA transcript produced includes a cap analog.

137. The method of any one of the preceding paragraphs, wherein the method produces at least 50%, at least 60%, or at least 75% more RNA transcript comprising a cap analog than a control in vitro transcription reaction comprising a wild-type RNA polymerase of SEQ ID NO: 1.

138. The method of any one of the preceding paragraphs, wherein a molar ratio of cap analog to nucleoside triphosphates in the reaction is between 1:10 and 1:1.

139. The method of any one of the preceding paragraphs, wherein less than 1%, less than 0.5%, or less than 0.1% of the RNA transcript produced is double-stranded RNA (dsRNA).

140. The method of any one of the preceding paragraphs, wherein the reaction produces at least 5 mg/mL, at least 6 mg/mL, at least 7 mg/mL, at least 8 mg/mL, at least 9 mg/mL, or at least 10 mg/mL of RNA transcript.

141. The method of any one of the preceding paragraphs, wherein at least 85%, at least 90%, or at least 95% of RNA transcript produced is a full-length RNA transcript.

142. The method of any one of the preceding paragraphs, wherein the method produces at least 10%, at least 25%, or at least 50% more RNA transcript comprising a cap analog than a control in vitro transcription reaction involving a control RNA polymerase variant, wherein the control RNA polymerase variant is derived from SEQ ID NO:1 and comprises a G47A mutation and an additional glycine at the C-terminal end.

143. A method comprising producing a RNA transcript in an in vitro transcription reaction that comprises a polynucleotide template, nucleoside triphosphates, a cap analog, and a wild-type RNA polymerase, wherein the cap analog is a trinucleotide cap analog or a tetranucleotide cap analog.

144. The method of paragraph 143, wherein the wild-type RNA polymerase comprises an amino acid sequence of SEQ ID NO: 1.

145. The method of paragraph 143 or 144, wherein the cap analog is a tetranucleotide cap analog that comprises GGAG.

146. The method of any one of paragraphs 143-145, wherein the tetranucleotide cap analog is selected from:

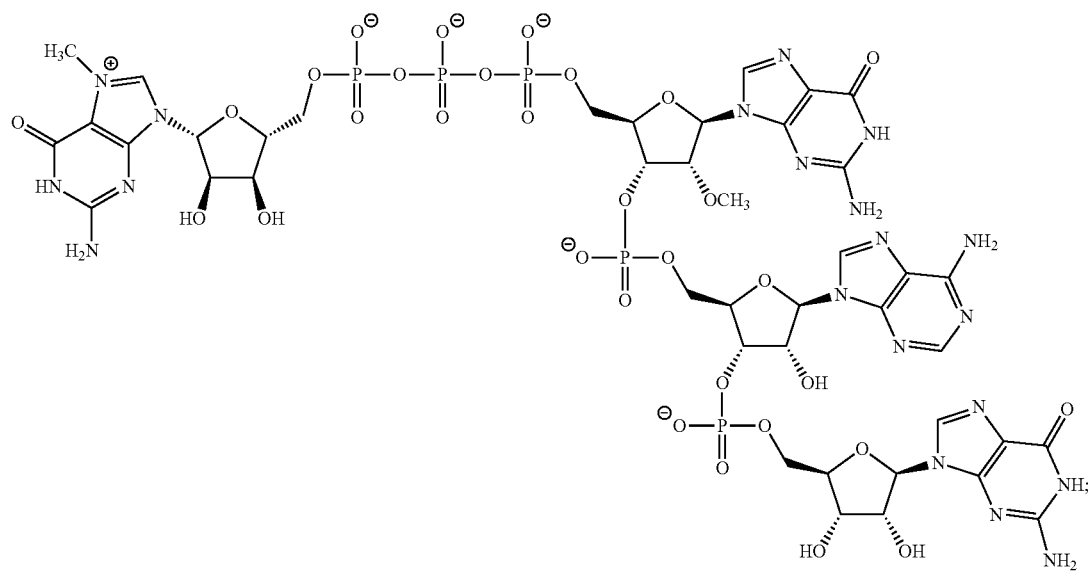
(iv)
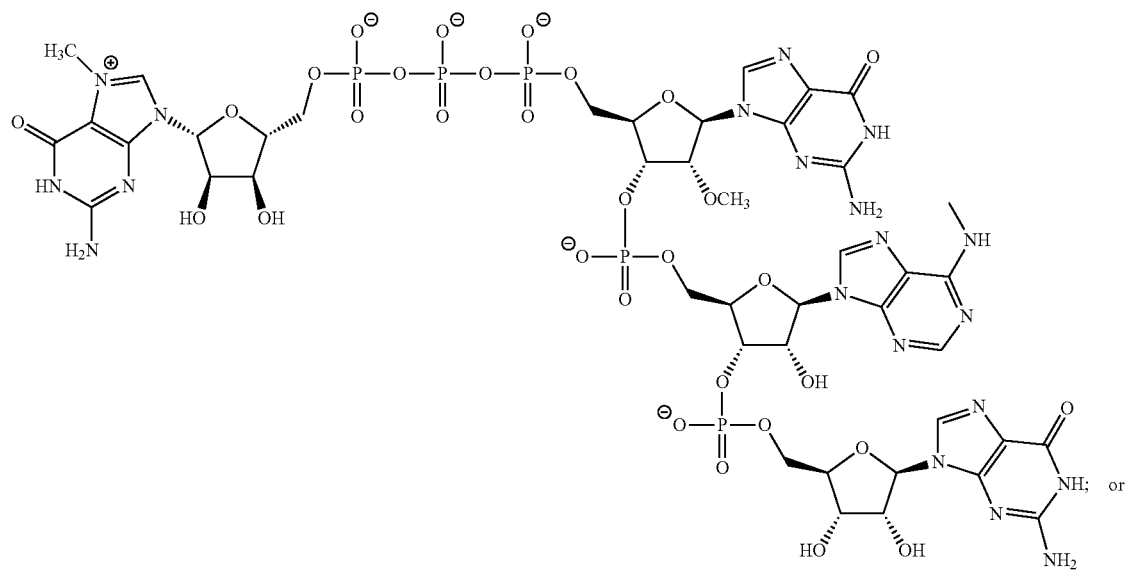
; or
(v)

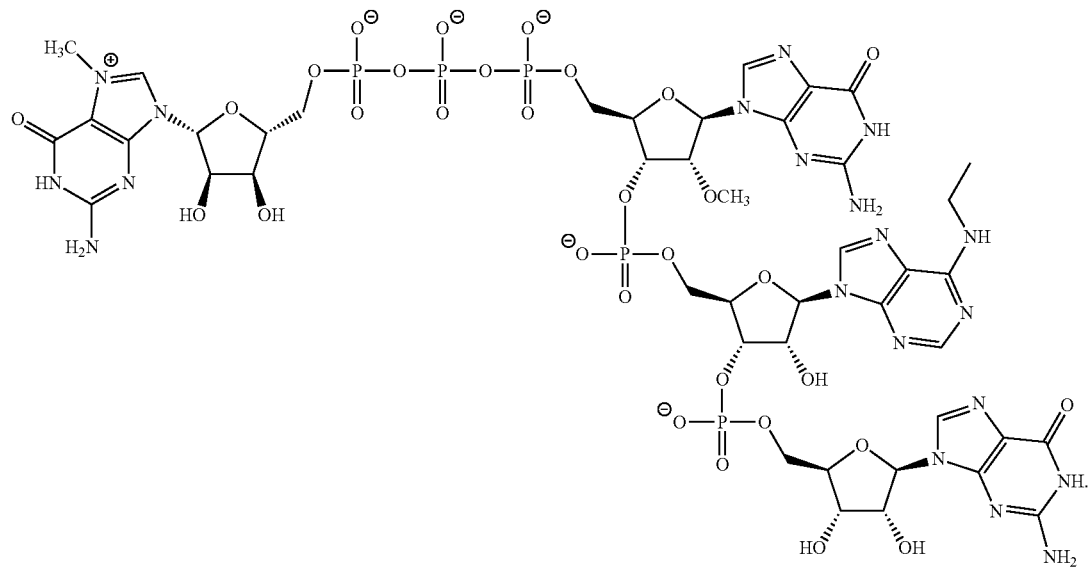

(vi)

Wild-type T7 RNA Polymerase (SEQ ID NO: 1)
MNTINIAKNDFSDIELAAIPFNTLADHYGERLAREQLALEHESYEMGEA
RFRKMFERQLKAGEVADNAAAKPLITTLLPKMIARINDWFEEVKAKRGK
RPTAFQFLQEIKPEAVAYITIKTILACLTSADNTTVQAVASAIGRAIED
EARFGRIRDLEAKHFKKNVEEQLNKRVGHVYKKAFMQVVEADMLSKGLL
GGEAWSSWHKEDSIHVGVRCIEMLIESTGMVSLHRQNAGVVGQDSETIE
LAPEYAEAIATRAGALAGISPMFQPCVVPPKPWTGITGGGYWANGRRPL
ALVRTHSKKALMRYEDVYMPEVYKAINIAQNTAWKINKKVLAVANVITK
WKHCPVEDIPAIEREELPMKPEDIDMNPEALTAWKRAAAAVYRKDKARK
SRRISLEFMLEQANKFANHKAIWFPYNMDWRGRVYAVSMFNPQGNDMTK
GLLTLAKGKPIGKEGYYWLKIHGANCAGVDKVPFTERIKFIEENHENIM
ACAKSPLENTWWAEQDSPFCFLAFCFEYAGVQHHGLSYNCSLPLAFDGS
CSGIQHFSAMLRDEVGGRAVNLLPSETVQDIYGIVAKKVNEILQADAIN
GTDNEVVTVTDENTGEISEKVKLGTKALAGQWLAYGVTRSVTKRSVMTL
AYGSKEFGFRQQVLEDTIQPAIDSGKGLMFTQPNQAAGYMAKLIWESVS
VTVVAAVEAMNWLKSAAKLLAAEVKDKKTGEILRKRCAVHWVTPDGFPV
WQEYKKPIQTRLNLMFLGQFRLQPTINTNKDSEIDAHKQESGIAPNFVH
SQDGSHLRKTVVWAHEKYGIESFALIHDSFGTIPADAANLFKAVRETMV
DTYESCDYLADFYDQFADQLHESQLDKMPALPAKGNLN1RDILESDFAF
A Control T7 RNA Polymerase Variant (G47A+C-terminal G)

(SEQ ID NO: 44)
MNTINIAKNDFSDIELAAIPFNTLADHYGERLAREQLALEHESYEMAE
ARFRKMFERQLKAGEVADNAAAKPLITTLLPKMIARINDWFEEVKAKR
CKRPTAFQFLQEIKPEAVAYITIKTTLACLTSADNTTVQAVASAICRA
IEDEARFGRIRDLEAKHFKKNVEEQLNKRVGHVYKKAFMQVVEADMLS
KGLLGGEAWSSWHKEDSIHVGVRCIEMLIESTGMVSLHRQNAGVVGQD
SETIELAPEYAEAIATRAGALAGISPMFQPCVVPFKFWTGITGGGYWA
NGRRPLALVRTHSKKALMRYEDVYMPEVYKAINIAQNTAWKINKKVLA
VANVITKWKHCPVEDIPAIEREELPMKPEDIDMNPEALTAWKRAAAAV
YRKDKARKSRRISLEFMLEQANKFANHKAIWFPYNMDWRGRVYAVSKF
NPQGNDMTKGLLTLAKGKPIGKEGYYWLKIHCANCACVDKVPFPERIK
FIEENHENIMACAKSPLENTWWAEQDSPFCFLAFCFEYACVQHHCLSY
NCSLPLAFDCSCSCIQHFSAMLRDEVCCRAVNLLPSETVQDIYCIVAK
KVNEILQADAINCTDNEVVTVTDENTCEISEKVKLCTKALACQWLAYC
VTRSVTKRSVMTLAYCSKEFCFRQQVLEDTIQPAIDSCKCLMFTQPNQ
AACYMAKLIWESVSVTVVAAVEAMNWLKSAAKLLAAEVKDKKTGEILR
KRCAVHWVTPDGFPVWQEYKKPIQTRLNLMFLGQFRLQPTINTNKDSE
IDAHKQESCIAPNFVHSQDCSHLRKTVVWAHEKYGIESFALIHDSFGT
IPADAANLFKAVRETMVDTYESCDVLADFYDQFADQLHESQLDKMPAL
PAKCNLNLRDILESDFAFAC

EXAMPLES

Example 1. Production of RNA Polymerases Variants

RNA polymerase variants were generated with the substitutions shown in Tables 2-6.

TABLE 2

RNA Polymerase Variants

| RNA Polymerase Variants | Amino Acid Sequence | SEQ ID NO |
|---|---|---|
| | For the amino acid sequences of SEQ ID NO: 2-14, 45-48, and 242-247, X may be any amino acid selected from R, K, H, E, D, Q, N, T, S, C, G, A, V, L, I, M, P, Y, W, and F. | |
| G47X | MNTINIAKNDFSDIELAAIPFNTLADHYGERLAREQLALEHESYEMXEARFRK MFERQLKAGEVADNAAAKPLITTLLPKM3ARINDWFEEVKAKRGKRPTAFQFL QEIKPEAVAYITIKTTLACLTSACNTTVQAVASAIGRAIEDEARFGRIRDLEA KHFKKNVEEQLNKRVGKVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNGAWKINKKVLAVANVITKWKHCPVEDIPAIEREELPMKPEDIDMNP EALTAWKRAAAAVYRKDKARKSRRISLEFMLFQANKFANHKATWFPYNMDWRG RVYAVSMFNPQGNDMTKGLLTLAKGKPIGKEGYYWLKIHGANCAGVDKVPFPE RIKFIEENHENIMACAKSPLENTQWAEQDSPFCFLAFCFEYAGVQHHGLSYNC SLPLAFDGSCSGIQHFSAMLRDEVGGRAVNLLPSETVQDIYGIVAKKVNEILQ ADAINGTDNVVWTVTDENTGEISEKVKLGYKALAGQWLAYGVTRSVTKRSVMT LAYGSKEFGFRQQVLEDTIQPAICSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKDGEIDAHKQEGGIAPNFVHSQDGGHLRKTV VWAHEKYGIESFALIHDSFGTIPADAANLFKAVRETMVDTYESCDVLADFYDQ FADQLHESQLDKMPALPAKGNLMLRDILESDFAFA | 2 |
| E350X | MNTINIAKNDFSDIELAAIPFNTLADHYGERLAREQLALEHESYEMGEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGKVYKKAFKQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVIIKWKHCPVXDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQPAICSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKCSEIDAHKQESGIAPNFVHSQDGSHLRKTV VWAHEKYGIESFALIHDSFGTIPADAANLFKAVRETMVDTYESCDVLADFYDQ FADQLHESQLPKMPALPAKGNLNLRDILESDFAFA | 3 |
| D351X | MNTINIAKMDFSDIELAAIPFNTLADHYGERLAREQLALEHESYEMGEARFRK MFERQLKAGEVADNAAAKPLITTLLPKMIARINDWFEEVKAKROKRPIAFQFL QEIKPEAVAYITIKTTLACLTSACNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRONAGVVGQDSETIELAFEYAEAIATRAGALAGIS PMFQPCVVPPKPWIGITGSGYWANGRRPLALVRTHSKKALMRYEDVYMPEVYK AINIAQNTAWKINKKVLAVANVIIKWKHCPVFXIPAIEREFLPMKPEDIDMNP EALTAWKRAAAAVYRKDKARKSRRISLEFMLEQANKFANHKAIWFPYNMDWRG RVYAVSMFNPQGNDMTKGLLTLAKCKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQWLAYGVTRSVTKRSVMT LAYGSKEFGFRQQVLEDTIQPAIESGKGLMFTQPNQAAGYMAKLIWESVSVTV VAAVEAMNWLKSAAKLLAAEVKDKKTGEILRKRCAVHWVIPDGFPVWQEYKKF IQTRLNLMFLGQFRLQPTININKCSEIDAHKQESGIAPNEVHSQDGSHLRKTV VWAHEKYGIESFALIHDSEGTIPADAANLFKAVRETMVDTYESCDVLADFYDQ FADQLHESQLDKMPALPAKCNLNLRDILESDFAFA | 4 |
| K387X | MNTINIAKNDFSDIELAAIPENTLADHYGERLAREQLALEHESYEMGEARFRK MFERQLKAGEVADNAAAKPLITTLLPKMIARINDWEEEVKAKRGKRPTAFQFL QEIKPEAVAYITIKTTLACLTSADNTTVQAVASAIGRAIEDEARFGRIRDLEA KHFKKNVEEQLNKRVGHYYKKAFMQVVEADMLSKGLLGGEAWSSWHKEDSIHV GVRCIEMLIESTGMVSLHRQNAGVVGQDSETIELAPEYAEAIATRAGALAGIS PMRQRCVVPPKRWIGITGGGYWANGKRPLAIVRTHSKKALMRYEDVYMREVYK | 5 |

TABLE 2-continued

RNA Polymerase Variants

| RNA Polymerase Variants | Amino Acid Sequence | SEQ ID NO |
|---|---|---|
| | AINIAQNIAWKINKKVLAVANVIIKWKHCPVEDIPAIEREELPMKREDIDMNP<br>EALTAWKRAAAAVYRXDKARKSRRISLEFMLEQANKFANHKAIWFPYNMDWRG<br>RVYAVSMENPQGNDMIKGILTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSCIQHFSAMLRDEVGGRAVNLLPSEIVQDIYGIVAKKVNEILQ<br>ADAINGIDNEVVTVTDENIGEISEKVKLGGKAIAGQWLAYGVIRSVGKRSVMT<br>LAYGSKEFGFRQQVLEDTIQPAICSGKGLMFTQPNQAAGYMAHLIWESVSVIV<br>VAAVEAMNWLKSAAKLLAAEVKDKKICEILRKRCAVHWVTPDGFPVWQEYKKP<br>IQTRINLMFLGQFRLQRTINTNKESEIDAHKQESGIAPNFVHSQDCSHIRKTV<br>VWAHEKYCIESFALIHDSECTIPADAANLFKAVRETMVDTYESCDVLADFYDQ<br>FADQLHESQLDKMPALPAKCNLNLRDILESDFAFA | |
| R394X | MNTINIAKNDFSDIELAAIPFNTLADHYGERLAREQLALEHESYEMGEARFRK<br>MFERQLKAGEVADNAAAKPLITTLLPKMIARINDWFEEVKAKRGKRPTAFQFL<br>QEIKPEAVAYITIKTTLACLTSACNTTVQAVASAIGRAIEDEARFGRIRDLEA<br>KHFFKKNVEEQLNKRVGHVYKKAFMQVVEADMESKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAHKRAAAAVYRKDKARKSXRISLEFMLEQANKFANHKAIWFPYNMDWRG<br>RVYAVSMFNPQGMDMXKGLLTLAKGKPIGKEGYYWLKIHGAMCAGVDKVPFPE<br>RIKFIEENHENIMACAKSPLENTAWAEQDSPECFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENXGEISEKVKLGTKALAGQWLAYGVTRSVGKRSVMT<br>LAYGSKEFGFRQQVLEDTIQPAIDSGKGLMFTQPNQAAGYMAKLTWESVSVTV<br>VAAVEAMNWLKSAAKLLAAEVKDKKTGEILRKRCAVHWVTPDGFPVWQEYKKP<br>IQTRLNLMFLGQFRLQPTINTNKCSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFA | 6 |
| R425X | MNTINIAKNDFSDIELAAIPFNTLADHYGERLAREQLALEHESYEMGEARFRK<br>MFERQLKAGEVADNAAAKPLITILLPKMIARINDWEEEVKAKRCKRPTAFQFL<br>QEIKPEAVAYITIKTTLACLISACNTIVQAVASAIGRAIEDEARFGRIRDLEA<br>KHFFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSCYWANGRRPLALVRTHSKKALMRYEDVYMPEVYK<br>AINIAQNTAWKINKKVLAVANVIIKWKHCPVEDIPAIEREELPMKPEDIDMNP<br>EALTAWKRAAAAVYRKDKARKSRRISLEFMLEQANKFANHKAIWFPYNMDWRG<br>XVYAVSMFNPQCNDMIKGILTLAKGKPIGKECYYWLKIHCANCAGVDKVPFPE<br>RIKFIEENHENIMACAKSPLENTWWAEQDSPFCFLAPCFEYAGVQHHGLSYNS<br>SLPLAFOGSCSGIQHFSAMLRDEVGGRAVNLLPSEIVQDIYGIVAKKVNEILQ<br>ADAINGIDNEVVTVTDENTCEISEKVKLGIKAIAGQWLAYGVIRSVIKRSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILKKRCAVHWVTPDGFPVWQEYKKP<br>IQTRLNLMFLGQFRLQPTININKCSEIDAHKQESGIAPNEVHSQDGSHLRKTV<br>VWAHEKYGIESFALIHDSEGTIPADAANLFKAVRETMVDIYESCDVLADFYDQ<br>FADQLHESQLDKMPALPAKGNLNLRDILESDFAFA | 7 |
| Y427X | MNTINIAKNDFSDIELAAIPENTLADHYGERLAREQLALEHESYEMGEARFRK<br>MFERQLKAGEVADNAAAKPLITILLPKMIARINDWFEEVKAKRGKRPTAFQFL<br>QEIKPEAVAYITIKTTLACLISACNTIVQAVASAIGRAIEDEARFCRIRDLEA<br>KHFFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGCYWANGRRPLALVRTHSKKALMRYEDVYMPEVYK<br>AINIAQNTAWKINKKVLAVANVIIKWKHCPVEDIPAIEREELPMKPEDIDMNP<br>EALTAWKRAAAAVYRKDKARKSRRTSLEFMLEQANKFANHKAIWFPYKMDWRG<br>RVXAVSMFNPQGNDMTKGLLTLAKGKPIGKEGYYWLKIHGANCAGVDKVPFDE<br>RIKFIEENHENIMACAKSPLENTWWAEQDSPFCFLAFGFEYAGVQHHGLSYNG<br>SLPLAFDCSCSCIQHFSAMLRDEVCCRAVNLLPSEIVQDIYCIVAKKVNEILQ<br>ACAINGTDNEVVTVTDENIGEISEKVKLGTKALACQWLAYSVIRSVTKRSVMT<br>LAYGSKEFGFRQQVLEDTIQPAICSGKGLMFTQPNQAAGYMAHLIWESVSVTV<br>VAAVEAMNWLKSAAKLLAACVKDKKTGEILRKRCAVHWVICDGFPVWQEYKKC<br>IQTRLNLMFLGQFRLQDTINTNKCSEIDAHKQESCIAPNFVHSQDGEHLRKTV<br>VWAHEKYGIESFALIHDSEGTIPADAANLFKAVRETMVDTYESCDVLADFYDQ<br>FADQLHESQLDKMDALPAKCNLNLRDILESDFAFA | 8 |
| N437X | MNTINIAKNDFSDIELAAIPFNTLADHYGERLAREQLALEHESYEMGEARFRK<br>MFERQLKAGEVADNAAAKPLITTLLPKMIARINDWFEEVKAKRGKRPTAFQFL<br>QEIKPEAVAYITIKTTLACLTSACNTTVQAVASAIGRAIEDEARFCRIRDLEA<br>KHFFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVDPKDWTCITCCCYWANCRRDLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRTSLEFMLEQANKFANHKAIWFPYKMDWRG | 9 |

TABLE 2-continued

RNA Polymerase Variants

| RNA Polymerase Variants | Amino Acid Sequence | SEQ ID NO |
|---|---|---|
| | RVYAVSMFNPQGXDMTKCLLTLAKCKCICKECYYWLKIHGANCACVDKVPFDE<br>RIKFIEENHENIMACAKSPLENTWWAEQDSPFCFLAFCFEYAGVQHHGLSYNC<br>SLPLAFDCSQSCIQHFSAMLRDEVCCRAVNLLPSEIVQDIYCIVAKKVNEILQ<br>ADAINGTDNEVVTVTDENTGEISEKVKLGTKALAGQWLAYGVTRSVTKRSVMT<br>LAYGSKEFGFRQQVLEDTIQPAIDSGKGLMFTQPNQAAGYMAKLIWESVSVTV<br>VAAVEAMNWLKSAAKLLAAEVKDKKTCEILRKRCAVHWVTPDCFPVWQEYKKP<br>IQTRLNLMFLCQFRLQPTINTNKCSEIDAHKQESCIAPNFVHSQDCSHLRKTV<br>VWAHEKYGIESFALIHDSEGTIPADAANLFKAVRETMVDTYESCDVLADFYDQ<br>FADQLHESQLDKMPALPAKGNLNLRDILESDFAFA | |
| K441X | MNTINIAKNDFSDIELAAIPFNTLADHYGERLAREQLALEHESYEMGEARFRK<br>MFERQLKAGEVADNAAAKPLITTLLPKMIARINDWFEEVKAKRGKRPTAFQYL<br>QEIKPEAVAYITIKTTLACLTSACNTTVQAVASAIGRAIEDEARFGRIRDLEA<br>KHFKKNVEEQLNKRVGHVYKKAFMQVVEADMLSKGLLGGEAWSSWHKEDSIHV<br>GVKCIEMCIESIGMVSLHKQNAGVVGQDSECIELAPEYAEAIAIRAGALAGIS<br>PMFQPCVVPPKPWTGITGSGYWANGRRPLALVRTHSKKALMRYEDVYMPEVYK<br>AINIAQNTAWKINKKVLAVANVIIKWKHCPVEDIPAIEREELPMKPEDIDMNP<br>EALTAWKRAAAAVYRKDKARKSRPTSLEFMLEQANKFANHKAIWFPYNMDWRG<br>RVYAVSMFNPQGNDMTXGLLTLAKGKPIGKEGYYWLKIHGANCAGVDKVPFPE<br>RIKFIEENHENIMACAKSDLENTWWAEQDSPFCFLAFCFEYAGVQHHCLSYNG<br>SLPLAFDGSCSGIQHPSAMLRDEVGGRAVNLLPSETVQDIYGIVAKKVNEILQ<br>ADAINGTDNEVVTVTDENTGEISEKVKLGTKATAGQWLAYSVTRSVTKRSVMT<br>LAYCSKEFCFRQQVLEDTIQPAICSCKCLMFTQPNQAACYMARLIWESVSVTV<br>VAAVEAMNWLKSAAKLLAAEVKDKKIGEILKKRCAVHWVIPCGPTVWQEYKKP<br>IQTRLNLMFLGQFRLQPTINTNKCSEIDAHKQESGIAPNFVHSQDGSHLRKTV<br>VWAHEKYCIESFALIHDSECTIPADAANLFKAVRETMVDTYESCDVLADFYDQ<br>FADQLHESQLDKMPALPAKGNLNLRDILESDFAFA | 10 |
| R632X | MNTINIAKNDFSDIELAAIDFNTLADHYGERLAREQLALEHESYEMCEARFRK<br>MFERQLKAGEVADNAAAKPLITTLLPKMIARINDWFEEVKAKRGKRPTAFQFL<br>QEIKDEAVAYITIKTTLACLTSACNTTVQAVASAIERAIEDEARFGRIRDLEA<br>KHFKKNVEEQLNKRVCHVYKKAFMQVVEADMLSKCLLCCEAWSSWHKEDSIHV<br>GVRCIEMLIESTGMVSLHRQNAGVVGQDSETIELAPEYAEAIATRAGALAGIS<br>PMFQPCVVPPKPWICITCSCYWANCRRPLALVRTHSKKALMRYEDVYMPEVYK<br>AINIAQNTAWKINKKVLAVANVIIKWKHCPVEDIPAIEREELPMKREDIDMNP<br>EALTAWKRAAAAVYRKDKARKSRRYSLEFMLEQANKFANHKAIWFDYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNG<br>SLPLAFDGSCSGIQHFSAMLRDEVGGRAVNLLPSEIVQDIYGIVAKKVNEILQ<br>ACAINGTDNEVVTVTDENIGEISEKVKLGTKALAGQWLAYSVTRSVTKXSVMT<br>LAYGSKEFGFRQQVLEDTIQPAICSGKGLMFTQPNCAAGYMAHLIWESVSVTV<br>VAAVEAMNWLKSAAKLLAAEVKDKKTGEILRKRCAVHWVTPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVREIMVDTYESCDVLADFYDQ<br>FADQLHESQLDKMPALPAKGNLNLRDILESDFAFA | 11 |
| H811X | MNTINIAKNDFSDIELAAIPFNTLADHYGETLAREQLALEHESYEMGEARFRK<br>MFERQLKAGEVADNAAAKPLITTLLPKMIARINDWEEEVKAKRGKRPTAFQFL<br>QEIKPEAVAYITIKTTLACLTSACNITVQAVASAIGRAIEDEARFGRIRDLEA<br>KHYKKNVEEQLNKRVCHVYKKAYMQVVEADMLSKCLLCCEAWSSWHKEDSIHV<br>GVRCIEMLIESTGMVSLHRQNAGVVGQDSETIELADEYAEAIATRAGALAGIS<br>PMFQPCVVPPKPWIGITGSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPTNMDWRG<br>RVYAVSMFNPQGNDMTKGLLTLAKGKPIGKEGYYWLKIHCANCACVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENICEISEKVKLGCKATACQWLAYGVTRSVCKRSVMP<br>LAYGSKEFGFRQQVLEDTIQPAICSGKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLCQFRLQPTINTNKDSEIDAHKQESCIAPNFVHSQDCSHLRKTV<br>VWAHEKYGIESFALIXDSEGTIPADAANLFKAVRETMVDTYESCDVLADFYDQ<br>FADQLHESQLDKMPALPAKGNLNLRDILESDFAFA | 12 |
| F880X | MNTINIAKNDFSDIELAAIFFNTLADHYGERLAREQLALEHESYEMGEARFRK<br>MFERQLKAGEVADNAAAKPLITTLLPKMIARINDWFEEVKAKRCKRPTAFQFL<br>QETKPEAVAYITIKTTLACLTSAENTTVQAVASATCRATEDEARFCRIRDLEA<br>KHFKKNVEEQLNKRVGHVYKKAFMQVVEADMLSKGLLGGEAWSSWHKEDSIKV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNPAWKINKKVLAVANVIIKWKHCPVEDIPAIEREELPMKPEDIDMNP<br>EALTAWKRAAAAVYRKDKARKSRPTSLEFMLEQANKFANHKAIWFDYNMDWRC<br>RVYAVSMFNPQGNDMTKGLLTLAKGKPIGKEGYYWLKIHGANCAGVDKVPFFE<br>RIKFIEENHENIMACAKSPLENTWWAEQDSPFCFLAFCFEYAGVQHHGLSYNC | 13 |

TABLE 2-continued

RNA Polymerase Variants

| RNA Polymerase Variants | Amino Acid Sequence | SEQ ID NO |
|---|---|---|
| | SLPLAFDGSCSCIQHFSAMLRDEVCCRAVNLLPSEIVQD1YCIVAKKVNEILQ ADAINGTDNEVVTVTDENIGEISEKVKLGCKATAGQWLAYGVTRSVCKRSVMP LAYGSKEFGFRQQVLEDTIQPAICSGKGLMETQPNQAAGYMAKLIWESVSVTV VAAVEAMNWLKSAAKLLAAEVKDKKTGEILRKRCAVHWVIPDGPTVWQEYKKP IQTRLNLMFLGQFRLQPTINTNKDSEIDAHKQESGIAPNFVHSQDGSHLRKTV VWAHEKYGIESFALIHDSFGTIPADAANLFKAVREIMVDTYESCDVLADFYDQ FADQLHESQLDKMPALPAKGNLNLRDILESDXAFA | |
| 884X | MNTINTAKNDFSDIELAAIPFNTLADHYGERLAREQLALEHESYEMGEARFRK MFERQLKAGEVADNAAAKPLITTLLPKMIARINDWFEEVKAKRGKRPTAFQFL QEIKPEAVAYITIKTTLACLTSACNTTVQAVASAIGRAIEDEARFQRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVIIKWKHCPVEDIPATEREELPMKPEDIDMNP EALTAWKRAAAAVYRKDKARKSRRISLEFMLEQANKFANNKAIWFPTNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDQSCSGIQHFSAMLRDEVGGRAVNLLDSEIVQDIYGIVAKKVNEILQ ADAINCTDNEVVTVTDENICEISEKVKLCCKALAGQWLAYSVTRSVCKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTDDGFPVWQEYKKP IQTRLNLMFLGQFRLQPTINTNKDSEIDAHKQESGIAPNFVHSQDGSHLRKTV VWAHEKYGIESFALIHDSEGTIPADAANLFKAVREIMVDTYESCDVLADFYDQ FADQLHESQLDKMPALTAKGNLNLRDILESDFAFAX | 14 |
| D506X | MNTINIAKNDFSDIELAAIPFNTLADHYCERLAREQLALEHESYEMCEARFRK MFERQLKAGEVADNAAAKPLITTLLPKMIARINDWFEEVKAKRGKRPTAFQFL QEIKPEAVAYITIKTTLACLTSACNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEATATRAGALAGIS PMFQPCVVPPKPWTGITGSGYWANGRRPLALVRTHSKKALMRYEDVYMPEVYK AINIAQNPAWKINKKVLAVANVIIKWKHCPVEDIPAIEREELPMKPEDIDMNP EALTAWKRAAAAVYRKDKARKSRRISLEFMLEQANKFANHKAIWFPYNMDWRG RVYAVSMFNPQCNDMTKGILTLAKGKPIGKECYYWLKIHCANCAGVDKVPFPE RIKFIEENHENIMACAKSPLENTWWAEQXSPFCFLAFCFEYAGVQHHQLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQQLAYGVTRSVTKRSVMT LAYCSKEFGFRQQVLEDTIQPAIESCKCLMFTQPNQAAGYMAKLIWESVSVTV VAAVEAMNWLKSAAKLLAAEVKDEKTGEILRKKCAVHWVTDDGFPVWQEYKKD IQTRLNLMFLGQFRLQPTINTNKESEIDAHKQESCIAPNFVHSQDCSHLRKTV VWAHEKYCIESFALIHDSFCTIPADAANLFKAVREIMVDTYESCDVLADFYDQ FADQLHESQLDKMPALFAKGNLNLKDILESDFAFA | 45 |
| S628X | MNTINIAKNDFSDIELAAIPFNTLADHYGERLAREQLALEHESYEMGEARFRK MFERQLKAGEVADNAAAKPLITTLLPKMIARINDWEEEVKAKRGKRPTAFQFL QEIKPEAVAYITIKTTLACLTSAENTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWIGITGSGYWANGRRPLALVRTHSKKALMRYEDVYMPEVYK AINIAQNTAWKINKKVLAVANVIIKWKHCPVEDIPAIEREELPMKPEDIDMNP EALTAWKRAAAAVYRKDKARKSRRLSLEFMLEQANKFANHKAIWFPYNMDWRG RVYAVSMFNPQGNDMTKGILTLAKGKPIGKECYYWLKIHCANCAGVDKVPFPE RIKFIEENHENIMACAKSPLENTWWAEQDSPFCFLAFCFEYACVQHHCLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQWLAYGVTRXVTKRSVMT LAYCSKEFCFRQQVLEDTIQPAICSCKCLMFTQPNQAACYMAHLIWESVSVTV VAAVEAMNWLKSAAKLLAAEVKDKKTGEILRKRCAVHWVTPDGFEWWQEYKKP IQTRLNLMFLGQFRLQPTINTNKCSEIDAHKQESGIAPNFVHSQDCSHLRKTV VWAHEKYCIESFALIHDSFCTIPADAANLFKAVREIMVDTYESCDVLADFYDQ FADQLHESQLDKMPALPAKCNLNLRDILESDFAFA | 46 |
| D653X | MNTINIAKNDFSDIELAAIFFNTLADHYGERLAREQLALEHESYEMGEAKFRK MFERQLKAGEVADNAAAKPLITTLLPKMIARINDWFEEVKAKRGKRRIAFQFL QEIKPEAVAYITIKTTLACLTSADNTTVQAVASAICRALEDEARKGRIRDLEA KHFKKNVEEQLNKRVGHVYKKAFMQVVEADMLSKGLLGGEAWSSWHKEDSIKV GVRCIEMLIESTGMVSLHRQNAGVVGQDSETIELAPEYAEAIATRAGALAGIS PMKQPCVVRPKYWIGITGSGYWANGRRPLALVRTHSKKALMRYEDVYMPEVYK AINIAQNTAWKINKKVLAVANVIIKWKHCPVEDIFAIEREELPMKPEDIDMND EALTAWKRAAAAVYRKDKARKSRPTSLEFMLEQANKFANHKAIWFPYNMDWRG RVYAVSMFNPQGNDMIKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDCSCSCIQHFSAMLRDEVGGRAVNLLPSEIVQDIYGIVAKKVNEILQ ADAINGIDNEVVTVTDENIGEISEKVKLGTKATAGQWLAYSVIRSVTKRSVMT | 47 |

TABLE 2-continued

RNA Polymerase Variants

| RNA Polymerase Variants | Amino Acid Sequence | SEQ ID NO |
|---|---|---|
| | LAYGSKEFGFRQQVLEXTIQPAIDSGKGLMFTQFNQAAGYMAHLIWESVSVIV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVREIMVDTYESCDVLADFYDQ FADQLHESQLDKMPALTAKCNLNLRDILESDFAFA | |
| P657X | MNTINIAKNDFSDIELAAIPFNTLADHYGERLAREQLALEHESYEMGEARFRK MFERQLKAGEVADNAAAKPLITTLLPKMIARINDWFEEVKAKRCKRPTAFQFL QEIKPEAVAYITIKTTLACLTSACNTTVQAVASAICRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYKKDKARKSRPTSLEFMLEQANKFANHKAIWFPYNMDWRG RVYAVSMFNPQCNDMTKGILTLAKGKPIGKEGYYWLKIHGANCAGVDKVPFPE RIKFIEENHENIMACAKSPLENTAWAEQDSPYCKLAPCFEYAGVQHHCLSYNC SLPLAFDGSCSGIQHFSAMLKDEVGGRAVNLLPSEIVQDIYGIVAKKVNEILQ ADAINGTDNEVVTVTDENTGEISEKVKLGTKALAGQWLAYGVTRSVTKRSVMT LAYCSKEFGFRQQVLEDTIQXAIDSCKCLMFTQPNQAAGYMAKLIWESVSVTV VAAVEAMNWLKSAAKLLAAEVKDKKTGEILRKRCAVHWVTPDGFPVWQEYKKD IQTRLNLMFLGQFRLQPTINTNKCSEIDAHKQESGIAPNFVHSQDGSHLRKTV VWAHEKYGIESEALIHDSFGTIPIDAANLFKAVREIMVDTYESCDVLADFYDQ FADQLHESQLDKMPALPAKGNLNLRDILESDFAFA | 48 |

TABLE 3

Exemplary Single-Substitution Variants

| RNA Polymerase Variants | Amino Acid Sequence | SEQ ID NO |
|---|---|---|
| G47A | MNTINIAKNDFSDIELAAIPFNTLADHYGERLAREQLALEHESYEMAEARFRK MFERQLKAGEVADNAAAKPLITTLLFKMIARINDWEEEVKAKRGKRFTAFQFL QEIKPEAVAYITIKTTLACLISACNTIVQAVASAICRAIEDEARFGRIRDLEA KHFKKNVEEQLNKRVGHVYKKAFMQVVEADMLSKGLLGGEAWSSWHKEDSIKV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRPTSLEFMLEQANKFANHKAIWFFYNMDWRG RVYAVSMFNPQGNDMIKGILTLAKGKPIGKEGYYWLKIHGANCAGVDKVPFPE RIKFIEENHENIMACAKSPLENTQMAEQDSPFCFLAFCFEYAGVQHHGLSYNC SLPLAFDQSCSGIQHFSAMLRDEVGGRAVNLLPSEIVQDIYGIVAKKVNEILQ ADAINGTDNEVVTVTDENTGEISEKVKLGTKALAGQWLAYGVTRSVTKRSVMT LAYGSKEFGFRQQVLEDTIQPAIESGKGLMFTQPNQAAGYMAKLIWESVSVTV VAAVEAMNWLKSAAKLLAAEVKDKKTGEILRKRCAVHWVTPDGFTVWQEYKKP IQTRLNLMFLGQFRLQPTINTNKCSEIDAHKQESGIAPNFVHSQDGSHLRKTV VWAHERYGIESFALIHDSFGTIPADAANLFKAVREIMVDTYESCDVLADFYDQ FADQLHESQLDKMPALFAKGNLNLRDILESDFAFA | 15 |
| E350K | MNTINIAKNDFSDIELAAIPFNTLADHYGERLAREQLALEHESYEMGEARFRK MFERQLKAGEVADNAAAKPLITTLLPKMIARINDWFEEVKAKRGKRPTAFQYL QEIKFEAVAYITIKTTLACLISACNTIVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSEIIELAPEYAEAIAIKAGALAGIS PMFQPCVVPPKPWTGITGSGYWANGRRPLALVRTHSKKALMRYEDVTMPEVYK AINIAQNTAWKINKKVLAVANVIIKWKHCPVKDIPAIEREELPMKPEDIDMNP EALTAWKRAAAAVYRKDKARKSRPTSLEFMLEQANKFANHKAIWFPYNMDWRG RVYAVSMFNFQGNDMIKGILTLAKGKPIGKEGYYWLKIRGANCAGVDKVFFFE RIKFIEENHENIMACAKSPLENTWWAEQDSPFCFLAFCFEYAGVQHHQLSYNC SLFLAFDGSCSGIQHFSAMLRDEVGGRAVNLLFSEIVQDIYGIVAKKVNEILQ ADAINGIDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFFVWQEYKKP IQTRLNLMFLGQFRLQPTINTNKCSEIDAHKQESGIAPNFVHSQDGSHLRKTV VWAHEKYGIESFALIHDSEGTIPADANLFKAVREIMVDTYESCDVLADFYDQ FADQLHESQLDKMPALPAKGNLNLRDILESDFAFA | 16 |
| E350N | MNTINIAKNDFSDIELAAIPFNTLADHYGERLAREQLALEHESYEMGEARFRK MFERQLKAGEVADNAAAKPLITTLLPKMIARINDWFEEVKAKROKRPTAFQFL QEIKPEAVAYITIKTILACLISAENTIVQAVASAIGRALEDEARYGRIRDLEA | 17 |

TABLE 3-continued

Exemplary Single-Substitution Variants

| RNA Polymerase Variants | Amino Acid Sequence | SEQ ID NO |
|---|---|---|
| | KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVIIKWKHCPVNDIPAIEREELPMKPEDIDMNP EALTAWKRAAAAVYRKDKARKSRRISLEFMLFQANKFANHKAIWFFYNMDWRG RVYAVSMFNPQGNDMTKGLLTLAKGKPIGKEGYYWLKIRGANCAGVDKVPYPE RIKFIEENHENIMACAKSPLENTOMAEQDSPFCFLAFCFEYAGVQHHGLSYNC SLPLAFOGSCSGIQHFSAMLRDEVGGRAVNLLPSEIVQDIYGIVAKKVNEILQ ADAINGTDNEVVTVTDENTGEISEKVKLGTKALAGQWLAYGVTRSVDKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTININKESEIDAHKQESGIAPNFVHSQDGSHLRKTV VWAHEKYGIESFALIHDSFGTIPADAANLFKAVREIMVDTYESCDVLADFYDQ FADQLHESQLDKMPALPAKCNLNLRDILESDFAFA | |
| E350A | MNTINIAKNDYSDIELAAIPFNTLADHYGERLAREQLALEHESYEMGEARYRK MFERQLKAGEVADNAAAKPLITTLLPKMIARINDWEEEVKAKRGKRPTAFQFL QEIKPEAVAYITIKTTLACLTSACNITVQAVASAIGRAIEDEARFGRIRDLEA KHYKKNVEEQLNKRVCHVYKKAYMQVVEADMLSKCLLCCEAWSSWHKEDSIHV GVRCIEMLIESTGMVSLHRQNAGVVGQDSETIELADEYAEAIATRAGALAGIS PMFQPCVVPPKPWTGITGSGYWANGRRPLALVRTHSKKALMRYEDVYMPEVYK AINIAQNCAWKINKKVLAVANVIIKWKHCPVADIPAIEREELPMKPEDIDMNP EALTAWKRAAAAVYRKDKARKSRRISLEFMLEQANKFANHKAIWFPTNMDWRG RVYAVSMFNPQGNDMTKGLLTLAKGKPIGKEGYYWLKIHCANCACVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENICEISEKVKLGCKATACQWLAYGVTRSVCKRSVMP LAYGSKEFGFRQQVLEDTIQPAICSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLCQFRLQPTINTNKDSEIDAHKQESCIAPNFVHSQDCSHLRKTV VWAHEKYGIESFALIHDSFGTIPADAANLFKAVRETMVDTYESCDVLADFYDQ FADQLHESQLDKMPALPAKGNLNLRDILESDFAFA | 18 |
| E350W | MNTINIAKNDFSDIELAAIFFNTLADHYGERLAREQLALEHESYEMGEARFRK MFERQLKAGEVADNAAAKPLITTLLPKMIARINDWFEEVKAKRCKRPTAFQFL QEIKPEAVAYITIKTTLACLTSAENTTVQAVASAICRAIEDEARFCRIRDLEA KHFKKNVEEQLNKRVGHVYKKAFMQVVEADMLSKGLLGGEAWSSWHKEDSIKV GVRCIEMLIESTGMVSLHRQNAGVVGQDSETTELAPEYAEAIATRAGALAGIS PMFQPCVVPPKEMTGITGGGYWANGRRPLALVRTHSKKALMRYEDVYMPEVYK AINIAQNPAWKINKKVLAVANVIIKWKHCPVWDIPAIEREELPMKPEDIDMNP EALTAWKRAAAAVYRKDKARKSRPTSLEFMLEQANKFANHKAIWFPYNMDWRC RVYAVSMFNPQGNDMTKGLLTLAKGKPIGKEGYYWLKIHGANCAGVDKVPFFE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENIGEISEKVKLGCKATAGQWLAYGVTRSVCKRSVMP LAYGSKEFGFRQQVLEDTIQPAIDSGKGLMETQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDGSHLRKTV VWAHEKYCIESFALIHDSFOTIPADAANLFKAVREIMVDTYESCDVLADFYDQ FADQLHESQLDKMPALPAKGNLNLRDILESDFAFA | 19 |
| D351V | MNTINIAKNDFSDIELAAIPFNTLADHYGERLAREQLALEHESYEMGEARFRK MFERQLKAGEVADNAAAKPLITTLLPKMIARINDWFEEVKAKROKRPTAFQFL QEIKPEAVAYITIKTTLACLTSACNTTVQAVASAICRAIEDEARFORIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNPAWKINKKVLAVANVIIKWKHCPVEVIPAIEREELPMKPEDIDMNP EALTAWKRAAAAVYRKDKARKSRRISLEFMLEQANKFANNKAIWFPTNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSEIVQDIYGIVAKKVNEILQ ADAINCTDNEVVTVTDENTGEISEKVKLCCKALAGQWLAYSVTRSVCKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNYVHSQDCSHLRKTV VWAHEKYGIESFALIHDSEGTIPADAANLFKAVREIMVDTYESCDVLADFYDQ FADQLHESQLDKMDALFAKGNLNLRDILESDFAFA | 20 |
| K387S | MNTINIAKNDFSDIELAAIPFNTLADHYGERLAREQLALEHESYEMGEARFRK MFERQLKAGEVADNAAAKPLITTLLPKMIARINDWEEEVKAKRGKRPTAFQFL QEIKPEAVAYITIKTTLACLTSAENTTVQAVASAICRAIEDEARFGRIRDLEA KHFKKNVEEQLNKRVGHVYKKAFMQVVEADMLSKGLLGGEAWSSWHKEDSIEV GVRCIEMLIESTGMVSLHRQNAGVVGQDSETIELAPEYAEAIATRAGALAGIS | 21 |

TABLE 3-continued

Exemplary Single-Substitution Variants

| RNA Polymerase Variants | Amino Acid Sequence | SEQ ID NO |
|---|---|---|
| | PMFQPCVVPPKPWIGITGSGYWANGRRPLALVRTHSKKALMRYEDVYMPEVYK<br>AINIAQNYAWKINKKVLAVANVIIKWKHCDVEDIPAIEREELPMKPEDIDMND<br>EALTANKRAAAAVYRSDKARKSRPLSLEFMLEQANKFANHKAIWFPYNMDWRC<br>RVYAVSMFNPQGNDMIKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSEIVQDIYGIVAKKVNEILQ<br>ADAINGTDNEVVTVTDENTGEISEKVKLGTKALAGQWLAYSVTRSVCKRSVMT<br>LAYGSKEFGFRQQVLEDTIQPAIDSGKGLMETQPNQAAGYMAHLIWESVSVTV<br>VAAVEAMNWLKSAAKLLAAEVKDKKTGEILRKRCAVHWVTDDGFPVWQEYKKD<br>IQTRLNLMFLGQFRLQPTINTNKPSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFA | |
| K387H | MNTINTAKNDFSDIELAAIDYNTLADHYGEKLAREQLALEHESYEMGEARYKK<br>MFERQLKAGEVADNAAAKPLITTLLPKMIARINDWEEEVKAKRGKRPTAFQFL<br>QEIKPEAVAYITIKTTLACLTSACNTTVQAVASAICRAIEDEARFCRIRDLEA<br>KHFKKNVEEQLNKRVGHVYKKAFMQVVEADMLSKGLLGGEAWSSWHKEDISHV<br>GVRCIEMLIESTGMVSLHRQNAGVVGQDSETIELAPEYAEAIATRAGALAGIS<br>PMFQPCVVPPKPWTGITGCCYWANGRRPLALVRTHSKKALMRYEDVYMPEVYK<br>AINIAQNTAWKINKKVLAVANVIIKWKHCPVEDIPAIEREELPMKPEDIDMNP<br>EALTANKRAAAAVYRHDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLDSEIVQDIYGIVAKKVNEILQ<br>ADAINGTDNEVVTVTDENTGEISEKVKLGTKALAGWQLAYGVTRSVTKRSVMT<br>LAYGSKEFGFRQQVLEDTIQPAIESGKGLMFTQPNQAAGYMAKLIWESVSVTV<br>VAAVEAMNWLKSAAKLLAAEVKDEKTGEILRKRCAVHWVTDDGFPDVWQEYKKD<br>IQTRLNLMFLGQFRLQPTINTNKCSEIDAHKQESGIAPNFVHSQDGSHLRKTV<br>VWAHEKYGIESEALIHDSECTIPADAANLFKAVREIMVDTYESCDVLADFYDQ<br>FADQLHESQLDHMDALPAKGNLNLRDILESDFAFA | 22 |
| K387N | MNTINIAKNDFSDIELAAIPFNTLADHYGERLAREQLALEHESYEMGEARFRK<br>MFDRQLKAGEVADNAAAKPLITTLLPKMIARINDWEEEVKAKRGKRPTAFQFL<br>QEIKPEAVAYITIKTTLACLTSACNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESIGMVSLHRQNAGVVGQDSEITELADEYAEATAIRAGALAGIS<br>PMFQPCVVDPKPWTGITGEGYWANGRRPLALVRTHSKKALMRYEDVYMPEVYK<br>AINIAQNYAWKINKKVLAVANVIIKWKHCPVEDIPAIEREELPMKPEDIDMNP<br>EALTAWKRAAAAVYRNDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYACVQHHGLSYNC<br>SLPLAFDGSCSGIQHFSAMLRDEVGGRAVNLLPSEIVQDIYGIVAKKVNEILQ<br>ADAINGTDNEVVTVTDENTGEISEKVKLGTKALAGWQLAYGVTRSVTKRSVMT<br>LAYGSKEFGFRQQVLEDTIQPAICSGKCLMFTQPNQAAGYMAHLIWESVSVTV<br>VAAVEAMNWLKSAAKLLAAEVKDKKIGEILRKRCAVHWVIDDGFPVWQEYKKD<br>IQTRLNLMFLGQFRLQPTINTNKCSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMDALPAKGNLNLRDILESDFAFA | 23 |
| D506W | MNTINIAKNDFSDIELAAIPFNTLADHYGERLAREQLALEHESYEMGEARFRK<br>MFERQLKAGEVADNAAAKPLITTLLPKMIARINDWFEEVKAKRGKRPTAFQFL<br>QEIKPEAVAYITIKTTLACLISACNTIVQAVASAIGRAIEDEARFGRIRDLEA<br>KHFKHNVEEQLNKRVCIWYKKAFMQVVEADMLSKGLLGGEAWHSWHKEDSIKV<br>GVRCIEMLIESTGMVSLHRQNAGVVGQDSETIELAPEYAEAIATRAGALAGIS<br>PMFQPCVVPPKPWIGITCSGYWANCRRPLALVRTHSKKALMRYEDVYMPEVYK<br>AINIAQNTAWKINKKVLAVANVIIKWKHCPVEDIPAIEREELPMKPEDIDMNP<br>EALTAWKRAAAAVYRKDKARKSRRISLEFMLEQANKFANHKAIWFDYNMDWRC<br>RVYAVSMFNPQGNDMIKCILTLAKCKPICKEGYYWLKIHGANCACVDKVPFPE<br>RIKFIEENHENIMACAKSPLENTWWAEQWSPFCFLAFCFEYAGVQHHCLSYNC<br>SLPLAFDCSCSCIQHFSAMLRDEVCCRAVNLLPSEIVQDIYCIVAKKVNEILQ<br>ADAINGIDNEVVTVTDENTGEISEKVKLGIKAIAGQWLAYSVIRSVIKRSVMT<br>LAYCSKEFGFRQQVLEDTIQPAIDSGKCLMFTQFNQAAGYMAHLIWESVSVTV<br>VAAVEAMNWLKSAAKLLAAEVKDKKTCEILRKRCAVHWTPDCFPVWQEYKKP<br>IQTRLNLMFLGQFRLQPTININKCSEIDAHKQESGIAPNFVHSQDGSHLRKTV<br>VWAHEKYGIESFALIHDSEGTIPADAANLFKAVREIMVDTIESCDVLADFYDQ<br>FADQLHESQLDKMPALPAKCNLNLRDILESDFAFA | 49 |
| S628W | MNTINIAKNDFSDIELAAIPFNTLADHYGERCANEQLALEHESIEMGEARYNK<br>MFERQLKAGEVADNAAAKPLITTLLPKMIARINDWFEEVKAKRGKRPTAFQFL<br>QEIKPEAVAYITIKTTLACLISACNTIVQAVASAICRAIEDEARFCRIRDLEA<br>KHFKKNVEEQLNKRVGHVYKKAFMQVVEADMLSKGLLGGEAWSSWHKEDSIKV<br>CVRCIEMLIESTCMVSLHRQNAGVVGQDSETIELAPEYAEAIATRAGALAGIS<br>PMFQPCVVPPKPWTCITCCCYWANCRRPLALVRTHSKKALMRYEDVYMPEVYK<br>AINIAQNTAWKINKKVLAVANVIIKWKHQPVEDIPAIEREELPMKPECIDMNP | 50 |

TABLE 3-continued

Exemplary Single-Substitution Variants

| RNA Polymerase Variants | Amino Acid Sequence | SEQ ID NO |
|---|---|---|
| | EALTAWKRAAAAVYRKDKARKSRRISLEFMLEQANKFANHKAIWFRYNMDWRG<br>RVYAVSMFNPQGNDMIKGILTLAKGKPIGKEGYYWLKIHGANCAGVDKVPFPE<br>RIKFIEENHENIMACAKSPLENTWWAEQCSPFCFLAFCFEYAGVQHHCLSYNG<br>SLPLAFDCSCSCIQHFSAMLRDEVGGRAVNLLFSETVQDIYGIVAKKVNEILQ<br>ADAINGIDNEVVTVTDENTGEISEKVKLGIKALAGQWLAYGVTRWVTKRSVMT<br>LAYCSKEFGFRQQVLEDTIQPAIDSGKGLMFTQPNQAAGYMAKLIWESVSVTV<br>VAAVEAMNWLKSAAKLLAAEVKDEKTCEILRKRCAVHWVTPDGFPVWQEYKKP<br>IQTRLNLMFLGQFRLQPTININKCSEIDAHKQESCIAPNFVHSQDCSHLRKTV<br>VWAHEKYGIESFALIHDSFCTIPADAANLFKAVREIMVDTYESCDVLADFYDQ<br>FADQLHESQLDHMPALFAKCNLNLRDILESDFAFA | |
| D653W | MNTINIAKNDFSDIELAAIPFNTLADHYGERLAREQLALEHESYEMGEARFRK<br>MFERQLKAGEVADNAAAKPLITILLLPKMIARINDWFEEVKAKRGKRPIAFQFL<br>QEIKPEAVAYITIKTTLACLISACNTIVQAVASAICRAIEDEARFGRIRDLEA<br>KHFKKNVEEQLNKRVGHVYKKAFMQVVEADMLSKGLLGGEAWSSWHKEDSIKV<br>GVRCIEMLIESTGMVSLHRQNAGVVGQDSETIELAPEYAEAIATRAGALAGIS<br>PMFQPCVVPPKPWIGITGEGYWANGRRPLALVRTHSKKALMRYEDVYMPEVYK<br>AINIAQNTAWKINKKVLAVANVIIKWKHCPVEDIPAIEREELDMKPEDIDMNP<br>EALTAWKRAAAAVYRKDKARKSRRLSLEFMLEQANKDANHKAIWYPINMDWNG<br>RVYAVSMFNPQGNDMIKGILTLAKGKPIGKEGYYWLKIHGANCAGVDKVPFPE<br>RIKFIEENHENIMACAKSDLENTWWAEQDSDFCFLAFCFEYACVQHHCLSYNC<br>SLPLAFDGSCSGIQHFSAMLRDEVGGRAVNLLPSEIVQDIYGIVAKKVNEILQ<br>ADAINGIDNEVVTVTDENIGEISEKVKLGIKALAGQWLAYGVTRSVIKRSVMT<br>LAYGSKEFGFRQQVLEWTIQPAICSGKGLMFTQPNQAAGYMAKLIWESVSVTV<br>VAAVEAMNWLKSAAKLLAAEVKDKKIGEILRKRCAVHWVIPDGFPVWQEYKKP<br>IQTRLNLMFLGQFRLQPTININKCSEIDAHKQESGIAPNFVHSQDGSHLRKTV<br>VWAHEKYGIESFALIHDSFGTIPADAANLFKAVREIMVDTYESCDVLADFYDQ<br>FADQLHESQLDKMPALPAKGNLNLRDILESDFAFA | 51 |
| P657W | MNTINIAKNDFSDIELAAIPFNTLADHYGERLAREQLALEHESYEMGEARFRK<br>MFERQLKAGEVADNAAAKPLITTLLPKMIARINDWFEEVKAKRGKRPTAFQFL<br>QEIKPEAVAYITIKTTLACLTSACNTTVQAVASAIGRAIEDEARFGRIRDLEA<br>KHFKKNVEEQLNKRVGHVYKKAFKQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNGAWKINKKVLAVANVIIKWKHCPVEDIPAIEREELPMKPEDIDMNP<br>EALTAWKRAAAAVYRKDKARKSRRISLEFMLEQANKFAMHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYGSKEFGFRQQVLEDTIQWAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKCSEIDAHKQESGIAPNFVHSQDGSHLRKTV<br>YWAHEKYGIESFALIHDSFGTIPADAANLFKAVRETMVDTYESCDVLADFYDQ<br>FADQLHESQLDKMPALPAKGNLNLRDILESDFAFA | 52 |

TABLE 4

Exemplary Multi-Substitution Variants

| RNA Polymerase Variants | Amino Acid Sequence | SEQ ID NO |
|---|---|---|
| G47A<br>E350K | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSACNTTVQAVASAICRAIEDEARFGRIRDLEA<br>KHZKKNVEEQLNKRVGEVYKKAFMQVVEADMLSKGLLGGEAWSSWHKEDSIEV<br>GVRCIEMLIESIGMVSLHRQNAGVVGQDSETIELAPEYAEAIATRAGALAGIS<br>PMFQPCVVPPKPWTGITGSCYWANGRRPLALVRTHSKKALMRYEDVYMPEVYK<br>AINIAQNCAWKINKKVLAVANVIIKWKHCPVKDIPAIEREELPMKPEDIDMNP<br>EALTANKRAAAAVYRKDKARKSRRISLEFMLEQANKFANHKAIWFPYNMDWRG<br>RVYAVSMFNPQGNDMTKGILTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFNCSGSCIQHFSAMLRDEVGGRAVNLLPSEIVQNIYGIVAKKVNEILQ<br>ADAINGTDNEVVTVTDENICEISEKVKLGCKALAGQWLAYGVTRSVTKRSVMT<br>LAYGSKEFGFRQQVLEDTIQPAIDSGKCLMFTQPNQAAGYMAHLIWESVSVTV | 24 |

TABLE 4-continued

Exemplary Multi-Substitution Variants

| RNA Polymerase Variants | Amino Acid Sequence | SEQ ID NO |
|---|---|---|
| | VAAVEAMNWLKSAAKLLAAEVKDKKTGEILRKRCAVHWVTPDGFPVWQEYKKP<br>IQTRLNLMFLGQFRLQFTINTNKDSEIDAHKQESGIAPNFVHSQDGSHLRKTV<br>VWAHEKYGIESFALIHDSFGTIPADAANLFKAVREIMVDIYESCDVLADFYDQ<br>FADQLHESQLDKMPALPAKGNLNLRDILESDFAFA | |
| G47A<br>E350N | MNTINIAKNDFSDIELAAIFFNTLADHYGERLARFQLALEHESYEMAEARFRK<br>MFERQLKAGEVADNAAAKPLITTLLPKMIARINDWFEEVKAKRGKRPTAFQFL<br>QEIKPEAVAYITIKTTLACLTSACNTTVQAVASAICRAIEDEARFGRIRDLEA<br>KHFKKNVFEQLNKRVGHVYKKAFMQVVEADMLSKGLLGGFAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNCANKINKKVLAVANVIIKWKHCPVNDIPAIEREELPMKDEDIDMND<br>EALTANKRAAAAVYRKDKARKSRPCSLEFMLEQANKFANHKAIWFPYNMDWRC<br>RVYAVSMFNPQGNDMTKGILTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSEIVQDIYGIVAKKVNEILQ<br>ADAINGTDNEVVTVTDENIGEISEKVKLGCKALAGQWLAYSVTRSVTKRSVMT<br>LAYCSKEFGFRQQVLEDTIQPAICSGKCLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKCSEIDAHKQESGIAPNFVHSQDGSHLRKTV<br>VWAHEKYGIESFALIHDSFGTIPADAANLFKAVREIMVDTYESCDVLADFYDQ<br>FADQLHESQLDKMPALDAKCNLNLRDILESDFAFA | 25 |
| G47A<br>E350A | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKDEAVAYITIKTILACLTSACNTTVQAVASAIGRAIEDEARFGRIRDLEA<br>KHFKKNVEEQLNKRVGHVYKKAFYQVVEADMLSKGLLGGEAWSSWHKEDSIHV<br>GVRCIEMLIESTGMVSLHRQNAGVVGQDSETIELAFEYAEAIATRAGALAGIS<br>PMFQPCVVDPKPWIGITGSGYWANGRRPLALVRTHSKKALMRYEDVYMPEVYK<br>AINIAQNTAWKINKKVLAVANVIIKWKHCPVADIPAIEREELPMKKEDIDMNP<br>EALTAWKRAAAAVYRKDKARKSRRESLEFMLEQANKFANHKAIWFPYNMDWRG<br>RVYAVSMENPQCNDMIKGLLTLAKGKDIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSEIVQDIYGIVAKKVNEILQ<br>ADAINGIDNEVVTVTDENTGEISEKVKLGTKALAGQWLAYSVTRSVTKRSVMT<br>LAYGSKEFGFRQQVLEDTIQPAIDSGKGLMFTQPNGAAGYMAHLIWESVSVTV<br>VAAVEAMNWLKSAAKLLAAEVKDKKTGEILRKRCAVHWVTPDGFPVWQEYKKP<br>IQTRLNLMFLGQFRLQPTININKESEIDAHKQESGIAPNEVHSQDGSHLRKTV<br>VWAHEKYGIESFALIHESEGTIPADAANLFKAVREIMVDTYESCDVLADFYDQ<br>FADQLHESQLDKMPALPAKGNLNLRDILESDFAFA | 26 |
| G47A<br>E350W | MNTINIAKNDFSDIELAAIPFNTLADHYGERLAREQLALEHESYEMAEARFRK<br>MFERQLKAGEVADNAAAKPLITTLLPKMIARINDWFEEVKAKROKRPTAFQFL<br>QEIKPEAVAYITIKTTLACLISADNTIVQAVASAICRAIEDEARFGRIRDLEA<br>KHFKKNVEEQLNKKVGHVYKKAKMQVVEADMESKGELGGEAWSSWHKEDSIHV<br>GVRCIEMLIESTGMVSLHRQNAGVVGQDSETIELAFEYAEAIATRAGALAGIS<br>PMFQPCVVPFKPWTCITGGGYWANGRRFLALVRTHSKKALMRYEDVYMFEVYK<br>AINIAQNTAWKINKKVLAVANVIIKWKHCPVWDIPAIEREELPMKPEDIDMNP<br>EALTAWKRAAAAVYRKDKARKSRRESLEFMLEQANKFANHKAIWFPYNMDWRC<br>RVYAVSMENFQGNDMIKGLLTLAKGKPICKEGYYWLKIHGANCAGVDKVFFPE<br>RIKFTEENHENIMACAKSPLENTWWAKQDSPFCFLAFCFEYAGVQHHGLSYNC<br>SLPLAFDGSCSGIQHFSAMLRDEVGGRAVNLLFSEIVQDIYGIVAKKVNEILQ<br>ADAINGIDNEVVTVTDENTGEISEKVKLGTKALAGQWLAYGVTRSVEKRSVMT<br>LAYGSKEFGFRQQVLEDTIQPAIESCKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTININKDSEIDAHKQESGIAPNEVHSQDGSHLRKTV<br>VWAHEKYGIESFALIHDSEGTIPADAANLFKAVREIMVDTYESCDVLADFYDQ<br>FADQLHESQLDKMPALPAKGNLNLRDILESDFAFA | 27 |
| G47A<br>D351V | MNTINIAKNDFSDIELAAIPENTLADHYGERLAREQLALEHESYEMAEARFRK<br>MFERQLKAGEVADNAAAKPLITTLLPKMIARINDWFEEVKAKRGKRPIAKQYL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWIGITGSGYWANGRRPLALVRTHSKKALMRYEDVYMPEVYK<br>AINIAQNTAWKINKKVLAVANVIIKWKHCPVEVIPAIEREELPMKPEDIDMNP<br>EALTAWKRAAAAVYRKDKARKSRPLSLEFMLEQANKFANHKAIWKPYKMDWRG<br>RVYAVSMENPQGNDMIKGLLTLAKGKPIGKEGYYWLKIHGANCAGVDKVPFPE<br>RIKFIEENHENIMACAKSPLENTWWAEQDSDFCFLAFCFEYAGVQHHQLSYNC<br>SLPLAFDGSCSGIQHFSAMLRDEVGGRAVNLLPSETVQDIYGIVAKKVNEILQ<br>ADAINGIDNEVVIVIDENIGEISEKVKLGTKALAGQWLAYSVTRSVEKRSVMT<br>LAYCSKEFGFRQQVLEDTIQPAIDSGKGLMFTQPNQAAGYMAKLIWESVSVTV<br>VAAVEAMNWLKSAAKLLAAEVKDKKTGEILRKRCAVHWVIPDGFPVWQEYKKP<br>IQTRLNLMFLGQFRLQPTINTNKDSEIDAHKQESGIAPNFVHSQDGSHLRKTV | 28 |

TABLE 4-continued

Exemplary Multi-Substitution Variants

| RNA Polymerase Variants | Amino Acid Sequence | SEQ ID NO |
|---|---|---|
| | VWAHEKYGIESFALIHDSEGTIPADAANLFKAVREIMVDTYESCDVLADFYDQ<br>FADQLHESQLDKMPALPAKGNLNLRDILESDFAFA | |
| G47A<br>K387S | MNTINIAKNDFSDIELAAIPFNTLADHYGERLAREQLALEHESYEMAEARFRK<br>MFERQLKAGEVADNAAAKPLITTLLPKMIARINDWFEEVKAKRCKRPTAFQFL<br>QEIKPEAVAYITIKTTLACLTSACNTTVQAVASAICRAIEDEARFGRIRDLEA<br>KHFKHNVEEQLNKRVCHVYKKAFMQVVEADMLSKCLLCCEAWSSWHKEDSIHV<br>GVRCIEMLIESTGMVSLHRQNAGVVGQDSETIELAPEYAEAIATRAGALACIS<br>PMFQPCVVPPKPWIGITGSGYWANGRRPLALVRTHSKKALMRYEDVYMPEVYK<br>AINIAQNYAWKINKKVLAVANVIIKWKHCPVEDIPAIEREELPMKPEDIDMNP<br>EALTAWKRAAAAVYRSDKARKSRRTSLEFMLEQANKFANHKAIWFPYNMDWRC<br>RVYAVSMFNPQCNDMIKGLLTLARGKPIGECYYWLKIHGANCAGVDKVPFPE<br>RIKFIEENHENIMACAKSPLENTWWAEQDSPFCFLAFCFEYAGVQHHGLSYNC<br>SLPLAFDCSCSCIQHFSAMLRDEVCGRAVNLLPSEIVQDIYCIVAKKVNEILQ<br>AaAINGTDNEVVTVTDENTGEISEKVKLGTKALAGQWLAYGVTRSVTKRSVMT<br>LAYGSKEFGFRQQVLEDTIQPAICSCKCKLMFTQPNQAACYMAHLIWESVSVTV<br>VAAVEAMNWLKSAAKLLAAEVKDKKTGEILRKRCAVHWVTPDCFPVWQEYKKP<br>IQTRLNLMFLCQFRLQPTINTNKCSEIDAHKQESCIAPNFVHSQDCSHLRKTV<br>VWAHEKYCIESFALIHDSECTIPADAANLFKAVREIMVDTYESCDVLADFYDQ<br>FADQLHESQLDKMPALPAKGNLNLRDILESDFAFA | 29 |
| G47A<br>K387H | MNTINIAKNDFSDIELAAIPFNTLADHYGERLAREQLALEHESYEMAEARFRK<br>MFERQLKAGEVADNAAAKPLITTLLPKMIARINDWFEEVKAKROKRPTAFQFL<br>QEIKPEAVAYITIKTTLACLTSACNTTVQAVASAIGRAIEDEARFGRIRDLEA<br>KHFKHNVEEQLNKRVGHVYKKAFMQVVEADMLSKGLLGGEAWSSWHKEDSIHV<br>CVRCIEMLIESTGMVSLHRQNAGVVGQDSETIELAPEYAEAIATRAGALAGIS<br>PMFQPCVVPPKPWTGITCCCYWANCRRPLALVRTHSKKALMRYEDVYMPEVYK<br>AINIAQN7AWKINKKVLAVANVIIKWKHCPVEDIPAIEREELPMKPEDIDMNP<br>EALTAWKRAAAAVYRHDKARKSRRTSLEFMLEQANKFANHKAIWFRYNMDWRC<br>RVYAVSMFNPGNDMTKGLLTLAKCKPIGKEGYYWLKIHGANCACVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSEIVQDIYGIVAKKVNEILQ<br>ADAINGTDNEVVTVTDENIGEISEKVKLGCKALAGQWLAYSVTRSVCKRSVMT<br>LAYGSKEFGFRQQVLEDTIQPAICSGKGLMFTQPNQAAGYMAKLIWESVSVTV<br>VAAVEAMNWLKSAAKLLAAEVKDEKTGEILRKRCAVHWVTPDCFPVWQEYKKP<br>IQTRLNLMFLCQFRLQPTINTNKCSEIDAHKQESGIAPNFVHSQDCSHLRKTV<br>VWAHEKYGIESFALIHDSEGTIPADAANLFKAVREIMVDTYESCDVLADFYDQ<br>FADQLHESQLDHMPALPAKGNLNLRDILESDFAFA | 30 |
| G47A<br>K387N | MNTINIAKNDFSDIELAAIPFNTLADHYCERLAREQLALEHESYEMAEARFRK<br>MFERQLKACEVADNAAAKPLITTLLPKMIARINDWEEEVKAKRCKRPTAFQFL<br>QEIKPEAVAYITIKTTLACLTSACNTTVQAVASAIGRAIEDEARFCRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWICITCSCYWANGRRPLALVRTHSKKALMRYEDVYMPEVYK<br>AINIAQNYAWKINKKVLAVANVIIKWKHCPVEDIPAIEREELPMKPEDIDMNP<br>EALTAWKRAAAAVYRNDKARKSRETSLEFMLEQANKFANHKAIWFCYNMDWRC<br>RVYAVSMFNPQGNDMTKCLLTLAKGKPIGKEGYYWLKIHGANCACVDKVPFPE<br>RIKFIEENHENIMACAKSDLENTWWAEQDSDFCFLAFCFEYACVQHHCLSYNC<br>SLPLAFDCSCSCIQHFSAMLRDEVCCRAVNLLPSETVQDIYGIVAKKVNEILQ<br>ADAINGTDNEVVTVTDENTGEISEKVKLGCKALAGQWLAYGVTRSVCKRSVMT<br>LAYCSKEFCFRQQVLEDTIQPAIDSCKCLMFTQPNQAACYMAHLIWESVSVTV<br>VAAVEAMNWLKSAAKLLAAEVKDKKTGEILRKRCAVHWVTPDGFPVWQEYKKP<br>IQTRLNLMFLGQFRLQPTINTNKCSEIDAHKQESGIAPNFVHSQDGSHLRKTV<br>VWAHEKYGIESFALIHDSFCTIPADAANLFKAVREIMVDTYESCDVLADFYDQ<br>FADQLHESQLDKMPALPAKGNLNLRDILESDFAFA | 31 |
| G47A<br>D506W | MNTINIAKNDFSDIELAAIPFNTLADHYGERLAREQLALEHESYEMAEARFRK<br>MFERQLKAGEVADNAAAKPLITTLLPKMIARINDWFEEVKAKRCKRPTAFQFL<br>QEIKPEAVAYITIKTTLACLTSACNTTVQAVASAICRAIEDEARFCRIRDLEA<br>KHFKHNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSCYWANGRRPLALVRTHSKKALMRYEDVYMPEVYK<br>AINIAQNTAWKINKKVLAVANVIIKWKHCPVEDIPAIEREELPMKREDIDMNP<br>EALTAWKRAAAAVYRKDKARKSRRTSLEFMLEQANKFANHKAIWFPYNMDWRC<br>RVYAVSMFNPQCNDMIKGLLTLAKOKPICKECYYWLKIHCANCACVDKVPFPE<br>RIKFIEENHENIMACAKSPLENTWWAEQWSPFCFLAFQFEYACVQHHCLSYNQ<br>SLPLAFDCSCSCIQHFSAMLRDEVCCRAVNLLPSEIVQDIYCIVAKKVNEILQ<br>ADAINGTDNEVVTVTDENTGEISEKVKLGTKALAGQWLAYGVTRSVTKRSVMT<br>LAYGSKEFGFRQQVLEDTIQPAIDSGKGLMFTQFNQAAGYMAHLIWESVSVTV<br>VAAVEAMNWLKSAAKLLAAEVKDKKTGEILRKRCAVHWVTPDCFPVWQEYKKP<br>IQTRLNLMFLGQFRLQPTINTNKCSEIDAHKQESGIAPNFVHSQDGSHLRKTV<br>VWAHEKYGIESFALIHDSEGTIPADAANLFKAVREIMVDTYESCDVLADFYDQ<br>FADQLHESQLDKMPALPAKCNLNLRDILESDFAFA | 53 |

TABLE 4-continued

Exemplary Multi-Substitution Variants

| RNA Polymerase Variants | Amino Acid Sequence | SEQ ID NO |
|---|---|---|
| G47A S628W | MNTINIAKNDFSDIELAAIPFNTLADHYGERLAREQLALEHESYEMAEARFRK MFERQLKAGEVADNAAAKPLITTLLPKMIARINDWFEEVKAKRCKRPTAFQFL QEIKPEAVAYITIKTTLACLTSACNTTVQAVASAIGRAIEDEARFCRIRDLEA KHFKKNVEEQLNKRVGHVYKKAFMQVVEADMLSKGLLGGEAWSSWHKEDSIHV CVRCIEMLIESTCMVSLHRQNAGVVGQDSETIELAPEYAEAIATRAGALAGIS PMFQPCVVPPKPWTGITCCCYWANCRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRLSLEFMLEQANKFANHKAIWFRYNMDWRG RVYAVSMFNPQCNDMTKGLLTLAKGKPIGKECYYWLKIHCANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSEIVQDIYGIVAKKVNEILQ ADAINGTDNEVVTVTDENTGEISEKVKLGYKALAGQWLAYGVTRWVCKRSVMT LAYCSKEFGFRQQVLEDTIQPAIDSCKCLMFTQPNQAAGYMAKLIWESVSVTV VAAVEAMNWLKSAAKLLAAEVKDRKTGEILRKRCAVHWVTPDGFPVWQEYKKP IQTRLNLMFLGQFRLQPTINTNKDSEIDAHKQESCIAPNFVHSQDCSHLRKTV VWAHEKYGIESFALIHDSFCTIPADAANLFKAVREIMVDTYESCDVLADFYDQ FADQLHESQLDHMPALFAKONLNLRDILESDFAFA | 54 |
| G47A D653W | MNTINIAKNDFSDIELAAIPFNTLADHYCERLAREQLALEHESYEMAEARFRK MFERQLKAGEVADNAAAKPLITTLLPKMIARINDWFEEVKAKRCKRPTAFQFL QEIKPEAVAYITIKTTLACLTSACNTTVQAVASAICRAIEDEARFCRIRDLEA KHFKKNVEEQLNKRVCHVYKKAFMQVVEADMLSKGLLGCEAWCSWHKEDSIHV GVRCIEMLIESTGMVSLHRQNAGVVGQDSETIELAPEYAEAIAIRAGALAGIS PMFQPCVVPPKPWTGITGSCYWANGRRPLALVRTHSKKALMRYEDVYMPEVYK AINIAQNTAWKINKKVLAVANVIIKWKHCPVEDIPAIEREELDMKDEDIDMND EALTAWKRAAAAVYRKDKARKSRRLSLEFMEFQANKEANHKAIWYPYNMDWRG RVYAVSMFNPQCNDMTKGLLTLAKCKPICKECYYWLKIHCANCACVDKVPFPE RIKFIEENHENIMACAKSDLENTWWAEQDSDFCFLAFQFEYACVQHHCLSYNQ SLPLAFDGSCSCIQHFSAMLRDEVGGRAVNLLPSEIVQDIYGIVAKKVNEILQ ADAINGTDNEVVTVTDENTGEISEKVKLGYKALAGQWLAYGVTRSVCHRSVMT LAYCSKEFGFRQQVLEWTIQPAIDSGKCLMETQPNQAAGYMAKLIWESVSVTV VAAVEAMNWLKSAAKLLAAEVKDKKIGEILRKRCAVHWVIPDGFPVWQEYKKP IQTRLNLMFLGQFRLQPTINTNKCSEIDAHKQESGIAPNFVHSQDCSHLRKTV VWAHEKYGIESFALIHDSFCTIPADAANLFKAVREIMVDTYESCDVLADFYDQ FADQLHESQLDKMPALPAKGNLNLRDILESDFAFA | 55 |
| G47A P657W | MNTINIAKNDFSDIELAAIPFNTLADHYGERLAREQLALEHESYEMAEARFRK MFERQLKAGEVnDNAAAKPLITTLLPKMIARINDWFEEVKAKRGKRPTAFQFP QEIKPEAVAYITIKTTLACLTSACNTTVQAVASAIGRAIEDEARFGRIRDLEA KHFKKNVEEQLNKRVGHVYKKAFKQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVIIKWKHCPVEDIPAIEREELPMKPEDIDMNP EALTAWKRAAAAVYRKDKARKSRRLSLEFMLEQANKFAMHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQWAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKCSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFA | 56 |

TABLE 5

Exemplary Multi-Substitution + C-Terminal G Variants

| RNA Polymerase Variants | Amino Acid Sequence | SEQ ID NO |
|---|---|---|
| G47A E350K C-Terminal G | MNTINIAKNDFSDIELAAIPTATLADHYGEKLAREQLALEHESYEMAEAKFRK MFERQLKAGEVADNAAAKPLITTLLPKMIARINDWFEEVKAKROKRPTAFQFL QEIKDEAVAYITIKTTLACLTSACNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVKDIPAIEREELPMKPEDINMNF EALTAWKRAAAAVYRKDKARKSRPTSLEFMLEQANKFANHKAIWFPYNMDWRG | 32 |

TABLE 5-continued

Exemplary Multi-Substitution + C-Terminal G Variants

| RNA Polymerase Variants | Amino Acid Sequence | SEQ ID NO |
|---|---|---|
| | RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHOLSYNC<br>SLPLAFDQSCSGIQHFSAMLRDEVGGRAVNLLPSEIVQDIYGIVAKKVNEILQ<br>ADAINGTDNEVVTVTDENTGEISEKVKLGTKATAGQWLAYCVTRSVTKRSVMT<br>LAYCSKEFGFRQQVLEDTIQPAIDSGKGLMFTQPNQAAGYMAKLIWESVSVTV<br>VAAVEAMNWLKSAAKLLAAEVKDEKTGEILRKRCAVHWVTPDGFPVWQEYKKP<br>IQTRLNLMFLGQFRLQPTINTNKESEIDAHKQESGIAPNFVHSQDGSHLRKTV<br>VWAHEKYGIESFALIHDSFGTIPADAANLFKAVREIMVDTYESCDVLADFYDQ<br>FADQLHESQLDKMPALFAKGNLNLRDILESDFAFAG | |
| G47A<br>E350N<br>C-Terminal G | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QFIKPEAVAYITIKTTLAGLTSAENTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVNDIPAIEREELPMKPEDIDMNP<br>EALTAWKRAAAAVYRKDKARKSRPTSLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNG<br>SLPLAFDGSCSGIQHFSAMLRDEVGGRAVNLLPSEIVQDIYGIVAKKVNEILQ<br>ADAINGTDNEVVTVTDENTGEISEKVKLGTKALAGQWLAYGVTRSVTKRSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKCSEIDAHKQESGIAPNFVHSQDGSHLRKTV<br>VWAHEKYGIESFALIHDSFGTIPADAANLFKAVRETHVDTYESCDVLADFYDQ<br>FADQLHESQLDKMPALPAKGNLNLRDILESDFAFAG | 33 |
| G47A<br>E350A<br>C-Terminal G | MNTINIAKNDFSDIELAAIFFNTLADHYGERLAREQLALEHESYEMAEARFRK<br>MFERQLKAGEVADNAAAKPLITTLLPKMIARINDWFEEVKAKRGKRFTAFQFL<br>QEIKPEAVAYITIKTTLACLTSACNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVADIPAIEREELPMKPEDIDMNP<br>EALTANKRAAAAVYRKDKARKSRRCSLEFMLEQANKFANHKAIWFPYNMDWRC<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHOLSYNC<br>SLPLAFDQSCSCIQHFSAMLRDEVGGRAVNLLPSEIVQDIYGIVAKKVNEILQ<br>ADAINGTDNEVVTVTDENTGEISEKVKLGTKALAGQWLAYGVTRSVTKRSVMT<br>LAYCSKEFGFRQQVLEDTIQPAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVREIMVDTYESCDVLADFYDQ<br>FADQLHESQLDKMPALPAKGNLNLRDILESDFAFAG | 34 |
| G47A<br>E350W<br>C-Terminal G | MNTINIAKNDFSDIELAAIPFNTLADHYGERLARECLALEHESYEMAEARFRK<br>MFERQLKACEVADNAAAKPLITTLLPKMIARINDWFEEVKAKRCKRPTAFQFL<br>QEIKPEAVAYIIIKTILACCTSACNITVQAVASAIGKAIEDEARYCRIRDLEA<br>KHFKKNVEEQLNKRVGHVYKKAFMQVVEADMLSKGLLGGEAWSSWHKEDSIHV<br>CVRCIEMLIESTCMVSLHRQNACVVCQDSETIELAPEYAEAIATRACALACIS<br>PMFQPCVVPPKPWTGITGGGYWANGRRPLALVRTHSKKALMRYEDVYMPEVYK<br>AINIAQNTAWKINKKVLAVANVITKWKHCPVWDIPAIEREELPMKPEDIDMNP<br>EALTAWKRAAAAVYRKDKARKSRRLSLEFMLEQANKFANHKAIWFPYNMDWRO<br>KVYAVSMFNPQCNDMTKGLLTLAKGKPIGKECYYWLKIHCANCAGVDKVPFPE<br>RIKFIEENHENIMACAKSPLENTWWAEQDSPFCFLAFQFEYACVQHHCLSYNC<br>SLPLAFDCSQSGIQHFSAMLRDEVGGRAVNLLPSEIVQDIYGIVAKKVNEILQ<br>ADAINCTDNEVVTVTDENIGEISEKVKLGYKALAGQVWAYGVTRSVYKRSVMT<br>LAYGSKEFGFRQQVLEDTIQPAICSGKGLMFTQPNQAAGYMAHLIWESVSVTV<br>VAAVEAMNWLKSAAKLLAAEVKDKKTGEILRKRCAVHWVTPDCFPVWQEYKKP<br>IQTRLNLMFLGQFRLQPTINTNKCSEIDAHKQESGIAPNFVHSQDGSHLRKTV<br>VWAHEKYGIESFALIHDSEGTIPADAANLFKAVREIMVDTYESCDVLADFYDQ<br>FADQLHESQLDKMPALPAKGNLNLRDILESDFAFAG | 35 |
| G47A<br>D351V<br>C-Terminal G | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSACNTTVQAVASAIGRAIEDEARFCRIRDLEA<br>KHFKKNVEEQLNKRVGHVYKKAFMQVVEADMLSKCLLGGEAWSSWHKEDSIHV<br>GVRCIEMLIESIGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNYAWKINKKVLAVANVIIKWKHCPVEVIPAIEREELPMKPEDIDMNP<br>EALTAWKRAAAAVYRKDKARKSRRYSLEFMLEQANKFANHKAIWFPYNMDWRG<br>RVYAVSMFNPQCNDMTKGLLTLAKGKPIGKECYYWLKIHCANCAGVDKVPFPE<br>RIKFIEENHENTMACAKSPLENTWWAEQDSPFCFLAFCFEYAGVQHHGLSYNC | 36 |

TABLE 5-continued

Exemplary Multi-Substitution + C-Terminal G Variants

| RNA Polymerase Variants | Amino Acid Sequence | SEQ ID NO |
|---|---|---|
|  | SLPLAFDCSCSCIQHFSAMLRDEVGCRAVNLLPSEIVQDIYGIVAKKVNEILQ<br>ADAINGTDNEVVTVTDENTGEISEKVGLGTKALAGQWLAYGVTRSVTKRSVMT<br>LAYGSKEFGFRQQVLEDTIQPAIDSCKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLCQFRLQPTINTNKCSEIDAHKQESCIAPNFVHSQDCSHLRKTV<br>VWAHEKYGIESEALIHDSECTIPADAANLFKAVREIMVDIYESCDVLADFYDQ<br>FADQLHESQLDKMPALPAKCNLNLRDILESDFAFAG |  |
| G47A<br>K387S<br>C-Terminal G | MNTINIAKNDFSDIELAAIPFNTLADHYGERLAREQLALEHESYEMAAEARFRK<br>MFERQLKAGEVADNAAAKPLITTLLPKMIARINDWFEEVKAKRGKRPTAFQFL<br>QEIKPEAVAYITIKTILACLTSACNTTVQAVASAICRAIEDEARFCRIRDLEA<br>KHFKHNVEEQLNKRVGHVYKKAFMQVVEADMLSKCLLCCEAWSSWHKEDSIHV<br>GVRCIEMLIESIGMVSLHRQNAGVVGQDSETIELAPEYAEAIATRAGALAGIS<br>PMFQPCVVPPKPWIGITGSCYWANGRRPLALVRTHSKKALMRYEDVYMPEVYK<br>AINIAQNTAWKINKKVLAVANVITKWKHCCVEDIPAIEREELPMKPEDIDMNC<br>EALTANKRAAAAVYRSDKARKSRPISLERMLEQANKFANHKAIMFPYNMDWRC<br>RVYAVSMFNPQCNDMIKGILTLAKGKPIGKECYYWLKIHGANGAGVDKVPFPE<br>RIKFIEENHENIMACAKSCLENTQMAEQDSCFCFLAFQFEYAGVQHHGLSYNC<br>SLPLAFDCSQSCIQHFSAMLRDEVCCRAVNLLPSEIVQDIYGIVAKKVNEILQ<br>ADAINGTDNEVVTVTDENICEISEKVKLGCKAGAGQWLAYSVTRSVGKRSVMT<br>LAYGSKEFGFRQQVLEDTIQPAIDSCKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLGQFRLQPTINTNKCSEIDAHKQESGIAPNFVHSQDGSHLRKTV<br>VWAHEKYGIESFALIHDSFGTIPADAANLFKAVREIMVDIYESCDVLADFYDQ<br>FADQLHESQLDKMPALPAKCNLNLRDILESDFAFAG | 37 |
| G47A<br>K387H<br>C-Terminal G | MNTINIAKNDFSDIELAAIPFNTLADHYGERLAREQLALEHESYEMAAEARFRK<br>MFERQLKAGEVADNAAAKPLITTLLPKMIARINDWFEEVKAKRGKRPTAFQFL<br>QEIKPEAVAYITIKTTLACLTSACNTTVQAVASAICRAIEDEARFCRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGCCYWANGRRPLALVRTHSKKALMRYEDVYMPEVYK<br>AINIAQNTAWKINKKVLAVANVITKWKHCPVEDIPAIEREFLPMKPEDIDMNP<br>EALTAWKRAAAAVYRHDKARKSRRISLEFMLEQANKFANHKAIWFRYNMDWRQ<br>RVYAVSMFNPQGNDMTKGLLTLAKGKPIGKEGYYWLKIHGANCAGVDKVPFPE<br>RIKFIEENHENIMACAKSPLENTWWAEQDSCFCFLAFGFEYAGVQHHGLSYNG<br>SLPLAFDGSGSGIQHFSAMLRDEVGGRAVNLLCSETVQDIYGIVAKKVNEILQ<br>ADAINGTDNEVVTVTDENTGEISEKVKLGYKALAGQWLAYSVTRSVYKRSVMT<br>LAYCSKEFCFRQQVLEDTIQPAICSGKCLMFTQPNQAAGYMAKLIWESVSVTV<br>VAAVEAMNWLKSAAKLLAAEVKDEKTGEILRKRCAVHWVTPDGFCVWQEYKKC<br>IQTRLNLMFLGQFRLQPTINTNKCSEIDAHKQESGIAPNFVHSQDGSHLRKTV<br>VWAHERYGIESFALIHDSFGTIPADAANLFKAVREIMVDTYESCDVLADFYDQ<br>FADQLHESQLDKMCALCAKGNLNLRDILESDFAFAG | 38 |
| G47A<br>K387N<br>C-Terminal G | MNTINIAKNDFSDIELAAIPFNTLADHYCERLAREQLALEHESYEMAAEARFRK<br>MFERQLKAGEVADNAAAKPLITTLLPKMIARINDWREEVKAKRGKRPIAFQFL<br>QEIKCEAVAYITIKTILACLTSACNTTVQAVASAICRAIEDEARFCRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIAIRACALAGIS<br>PMFQPCVVPPKPWTGITGSCYWANGRRPLALVRTHSKKALMRYEDVYMPEVYK<br>AINIAQNTAWKINKKVLAVANVIIKWKHCPVEDIPAIEREELPMKPEDIDMNP<br>EALTAWKRAAAAVYRNDKARKSRRISLEFMLEQANKFANHKAIMFPYNMDWRG<br>RVYAVSMFNPQGNDMTKGLLTLAKGKPIGKEGYYWLKIHGANQAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSEIVQDIYGIVAKKVNEILQ<br>ADAINGTDNEVVTVTDENIGEISEKVKLGYKALAGQWLAYGVTRSVYKRSVMT<br>LAYCSKEFGFRQQVLEDTIQPAIDSGKCLMFTQPNQAAGYMAHLIWESVSVTV<br>VAAVEAMNWLKSAAKLLAAEVKDKKIGEILRKRCAVHWIPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVREIMVDTYESQDVLADFYDQ<br>FADQLHESQLDKMPALPAKGNLNLRDILESDFAFAG | 39 |
| G47A<br>D506W<br>C-Terminal G | MNTINIAKNDFSDIELAAIPFNTLADHYGERLAREQLALEHESYEMAAEARFRK<br>MFERQLKAGEVADNAAAKPLITTLLPKMIARINDWFEEVKAKRGKRPTAFQFL<br>QEIKPEAVAYITIKTILACLTSACNTTVQAVASAICRAIEDEARFCRIRDLEA<br>KHFKHNVEEQLNKRVGHVYKKAFMQVVEADMLSKCLLGGEAWSSWHKEDSIHV<br>GVRCIEMLIESIGMVSLHRQNAGVVGQDSETIELAPEYAEAIATRAGALAGIS<br>PMFQPCVVPPKPWIGITGSCYWANGRRPLALVRTHSKKALMRYEDVYMPEVYK<br>AINIAQNTAWKINKKVLAVANVITKWKHCCVEDICAIEREELPMKPEDIDMNC<br>EALTANKRAAAAVYRKDKARKSRRLSLEEMLEQANKFANHKAIMFPYNMDWRC<br>RVYAVSMFNPQCNDMIKGILTLAKGKPIGKECYYWLKIHGANGAGVDKVPFPE<br>RIKFIEENHENIMACAKSCLENTWWAEQWSPFCFLAFQFEYAGVQHHGLSYNC<br>SLPLAFDCSQSCIQHFSAMLRDEVCCRAVNLLPSEIVQDIYCIVAKKVNEILQ<br>AaAINGTDNEVVTVTDENTGEISEKVKLGCKAGAGQWLAYSVTRSVGKRSVMT | 57 |

TABLE 5-continued

Exemplary Multi-Substitution + C-Terminal G Variants

| RNA Polymerase Variants | Amino Acid Sequence | SEQ ID NO |
|---|---|---|
| | LAYGSKEFGFRQQVLEDTIQPAIDSCKGLMFTQPNQAAGYMAHLIWESVSVTV VAAVEAMNWLKSAAKLLAAEVKDKKTGEILRKCAVHWVTPDGFPVWQEYKKP IQTRLNLMFLGQFRLQPTINTNKCSEIDAHKQESGIAPNFVHSQDGSHLRKTV VWAHEKYCIESFALIHDSECTIPADAANLFKAVREIMVDIYESCDVLADFYDQ FADQLHESQLDKMPALPAKCNLNLRDILESDFAFAG | |
| G47A S628W C-Terminal G | MNTINIAKNDFSDIELAAIPENTLADHYGERLAREQLALEHESYEMAEARFRK MFERQLKAGEVADNAAAKPLITTLLPKMIARINDWFEEVKAKROKRPTAFQFL QEIKPEAVAYITIKTTLACLTSACNTTVQAVASAICRAIEDEARFCRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPQVVPPKPWTGITGCCYWANGRRPLALVRTHSKKALMRYEDVYMPEVYK AINIAQNTAWKINKKVLAVANVITKWKHCPVEDIPAIEREFLPMKPEDIDMNP EALTAWKRAAAAVYRKDKARKSRRISLEFMLEQANKFANHKAIWFRYNMDWRQ RVYAVSMFNPQGNDMTKGLLTLAKGKPIGKEGYYWLKIHGANCAGVDKVPFPE RIKFIEENHENIMACAKSPLENTWWAEQDSPFCFLAFGFEYAGVQHHGLSYNG SLPLAFDGSGSGIQHFSAMLRDEVGGRAVNLLCSEIVQDIYGIVAKKVNEILQ ADAINGTDNEVVTVTDENTGEISEKVKLGYKALAGQWLAYGVTRWVYKRSVMT LAYCSKEFCFRQQVLEDTIQPAIDSGKCLMFTQPNQAAGYMAKLIWESVSVTV VAAVEAMNWLKSAAKLLAAEVKDEKTGEILRKCAVHWVTCDGFCVWQEYKKC IQTRLNLMFLGQFRLQPTINTNKCSEIDAHKQESGIAPNFVHSQDGSHLRKTV VWAHERYCIESFALIHDSECTIPADAANLFKAVREIMVDTYESCDVLADFYDQ FADQLHESQLDKMCALCAKGNLNLRDILESDFAFAG | 58 |
| G47A D653W C-Terminal G | MNTINIAKNDFSDIELAAIPFNTLADHYCERLAREQLALEHESYEMAEARFRK MFERQLKAGEVADNAAAKPLITTLLPKMIARINDWREEVKAKRGKRPIAFQFL QEIKCEAVAYITIKTILACLTSACNTTVQAVASAIGRAIEDEARFCRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIAIRACALAGIS PMFQPCVVPPKPWTGITGSCYWANGRRPLALVRTHSKKALMRYEDVYMPEVYK AINIAQNTAWKINKKVLAVANVIIKWKHCPVEDIPAIEREELPMKPEDIDMNP EALTAWKRAAAAVYRKDKARKSRRLSLEFMLEQANKFANHKAIWYCYNMDWRG RVYAVSMFNPQGNDMTKGLLTLAKGKPIGKEGYYWLKIHGANQAGVDKVPFPE RIKFIEENHENIMACAKSDLENTWWAEQDSPFCFLAFQFEYAGVQHHCLSYNC SLPLAFDGSCSGIQHFSAMLRDEVGGRAVNLLPSEIVQDIYGIVAKKVNEILQ ADAINGTDNEVVTVTDENIGEISEKVKLGYKALAGQWLAYGVTRSVYKRSVMT LAYGSKEFGFRQQVLEWTIQPAIDSGKGLMETQPNQAAGYMAKLIWESVSVTV VAAVEAMNWLKSAAKLLAAEVKDKKIGEILRKCAVHWVIPDGFPVWQEYKKP IQTRLNLMFLGQFRLQPTINTNKCSEIDAHKQESGIAPNFVHSQDGSHLRKTV VWAHEKYGIESFALIHDSFGTIPADAANLFKAVREIMVDTYESQDVLADFYDQ FADQLHESQLDKMPALPAKGNLNLRDILESDFAFAG | 59 |
| G47A P657W C-Terminal G | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFP QEIKPEAVAYITIKTTLACLTSACNITVQAVASAIGRAIEDEARFGRIRDLEA KHFKKNVEEQLNKRVGHVYKKAFKQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFFE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQWAIDSGKGLMFTQPNQAAGYMAKLIWESVSVTV VAAVEAMNWLKSAAKLLAAEVKDKKTGEILRKCAVHWVTPDGFPVWQEYKKP IQTRLNLMFLGQFRLQPTINTNKCSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 60 |

TABLE 6

Additional Multi-Substitution Variants

| RNA Polymerase Variants | Amino Acid Sequence | SEQ ID NO |
|---|---|---|
| G47A E350X$_1$, wherein X$_1$ is A, K, N, or W D351V K387X$_2$, wherein X$_2$ is S, H, or N C-Terminal G | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSACNTTVQAVASAIGRAIEDEARFGIRRDLEA KHFKKNVFEQLNKRVGHVYKKAFMQVVEADMLSKGLLGGFAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVX$_1$VIPAIEREELPMKPEDIDMN PEALTAWKRAAAAVYRX$_2$DKARKSRRISLEFMLEQANKFANHKAIWFPYNMDW RGRVYAVSMFNPQGNDMTKGLLTLAKGKPIGKEGYYWLKIHGANCAGVDKVPF PERIKFIEENHENIMACAKSPLENTWWAEQDSPFCFLAFCFEYAGVQHHGLSY NCSLPLAFDGSCSGIQHFSAMLRCEVGGRAVNTLPSETVQDIYGIVAKKVNEI LQADAINCTDNEVVTVTDENTCEISEKVKLGTKALACQWLAYCVTRSVTKRSV MTLAYGSKEFGFRQQVLEDTIQPAIDSGKGLMFTQPNQAAGYMAKLIWESVSV TVVAAVEAMNWLKSAAKLLAAEVKDKKTGEILRKRCAVHWVTPDGFPVWQEYK KPIQTRLNLMFLGQFRLQPTINTNKDSEIDAHKQESGIAPNFVHSQDGSHLRK TVVWAHEKYGIESFALIHDSFGTIPADAANEFKAVRETMVDTYESCDVLADFY DQFADQLHESQLDKMPALPAKGNLNLRDILESDFAFAG | 40 |
| G47A N437X$_1$, wherein X$_1$ is T, Y, I, or F K441R C-Terminal G | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGIRRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNYAWKINKKVLAVANVIIKWKHCPVEDIPAIEREELPMKPEDIDMNP EALTANKRAAAAVYRKDKARKSRRYSLEFMLEQANKFANHKAIWFPYNMDWRG RVYAVSMFNPQGXDMTRGLLTLAKGKPIGKEGYYWLKIHGANCAGVDKVPFPE RIKFIEENHENIMACAKSDLENTWWAEQDSDFCFLAPCFEYAGVQHHGLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQWLAYSVTRSVYKRSVMT LAYGSKEFGFRQQVLEDTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQFRLQPTINTNKCSEIDAHKQESGIAPNFVHSQDGSHLRKTV VWAHEKYGIESFALIHDSFGTIPADAANLFKAVRETHVDTTESCDVLADFYDQ FADQLHESQLDKMPALPAKGNLNLRDILESDFAFAG | 41 |
| G47A F880Y C-Terminal X, wherein X is A, S, T, or P | MNTINIAKNDFSDIELAAIFFNTLADHYGERLAREQLALEHESYEMAEARFRK MFERQLKAGEVADNAAAKPLITTLLPKMIARINDWFEEVKAKRGKRPTAFQFL QEIKPEAVAYITIKTILACLISACNTTVQAVASAIGRAIEDEARFGIRRDLEA KHFKKNVEEQLNKRVGHVYKKAFMQVVEADMLSKGLLGGEAWSSWHKEDSIWV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVIMPEVYK AINIAQNIAWKINKKVLAVANVIIKWKHCPVEDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSCIQHFSAMLRDEVGGRAVNLLPSEIVQDIYGIVAKKVNEILQ ADAINGIDNEVVTVTDENIGEISEKVKLGTKAIAGQWLAYSVTRSVTHRSVMT LAYCSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTININKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDYAFAX | 42 |
| G47A R632X$_1$, wherein X$_1$ is K or T D653X$_2$, wherein X$_2$ is T or K P657X$_3$, wherein X$_3$ is W, R, or A C-Terminal G | MNTINIAKNDFSDIELAAIPPNTLADHYGERLAREQTALEHESYEMAEARFRK MFERQLKAGEVADNAAAKPLITTLLPKMIARINDWFEEVKAKRCKRPTAFQFL QEIKPEAVAYITIKTTLACLTSADNTTVQAVASAIGRAIEDEARFGIRRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGTGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRPISLEFMLEQANKFANHKAIWFPYNMDWRG KVYAVSMFNPQGNDMTKGLLTLAKGKPIGKEGYYWLKIHGANCAGVDKVPFDE RIKFIEENHENIMACAKSPLENTWWAEQDSPFCFLAFCFEYAGVQHHGLSYNG SLPLAFDGSCSGIQHFSAMLRDEVGGRAVNLLPSEIVQDIYGIVAKKVNEILQ ADAINGTDNEVVTVTDENTGEISEKVKLGTKALAGQWLAYGVTRSVTKX$_1$SVM TLAYGSKEFGFRQQVLEX$_2$TIQX$_3$AIDSGKGLMFTQPNQAAGYMAKLIWESVS VTVVAAVEAMNWLKSAAKLLAAEVKDKKTGEILRKRCAVHWVTPDGFPVWQEY KKPIQTRLNLMFLGQFRLQPTINTNKDSEIDAHKQESGIAPNFVHSQDGSHLR KTVVWAHEKYGIESFALIHDSFGTIPADAANLFRAVREIMVDTYESCDVLADF YDQFADQLHESQLDKMPALPAKGNLNLRDILESDFAFAG | 43 |

TABLE 6-continued

Additional Multi-Substitution Variants

| RNA Polymerase Variants | Amino Acid Sequence | SEQ ID NO |
|---|---|---|
| G47A, K387N, G884 | MNTINIAKNDFSDIELAAIPFNTLADHYGERLAREQLALEHESYEMAEARFRK<br>MFERQLKAGEVADNAAAKPLITTLLPKMIARINDWEEEVKAKRGKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRNDKARKSRRISLEFMLEQANKFANHKAIWFPYNMDWRG<br>RVYAVSMFNPQGNDMTKGLLTLAKGKPIGKEGYYWLKIHGANCAGVDRVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTFRSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDRMPALPAKGNLNLRDILESDFAFAG | 61 |
| G47A, G884T | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRLSLEFMLEQANKFANHKAIWFPYNMDWRG<br>RVYAVSMFNPQGNDMTKGLLTLAKGKPIGKEGYYWLKIHGANCAGVDHVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGIDNEVVTVTDENTGEISEKVKLGLKAGAGQWLAYGVTRSVLKRSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAT | 62 |
| G47A, G884T, K387N | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLAGLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWIGITGGGYWANGRRPLALVRTHSKKALMRYEDVYMPEVYK<br>AINIAQNLAWKINKKVLAVANVITKWKHCPVEDIPAIEREELPMKPEDIDMNP<br>EALTAWKRAAAAVYRNDKARKSRPISLEFMLEQANKFANHKAIWFPYNMDWPG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDCSCSCIQHFSAMLRDEVCCRAVNLLPSEIVQDIYGIVAKKVNEILQ<br>ADAINGTDNEVVTVTDENTGEISEKVKLGTKALAGQWLAYSVTRSVTKRSVMT<br>LAYGSKEFGFRQQVLEDTIQPAICSGKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAT | 63 |
| G47A, G884S | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISCKVKLGLKALAGQWLAYSVTRSVLKRSVMT<br>LAYGSKEFGFRQQVLEDTIQPAIDSGKGLMFIQPNQAAGYMAHLIWESVSVTV<br>VAAVEAMNWLKSAAKLLAAEVKDKKTGEILRKRCAVHWVIPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVPTYESCDVLADFYDQ<br>FADQLHESQLDKMPALPAKGNLNLRDILESDFAFAS | 64 |

TABLE 6-continued

Additional Multi-Substitution Variants

| RNA Polymerase Variants | Amino Acid Sequence | SEQ ID NO |
|---|---|---|
| G47A, G884S, K387N | MNTINIAKNDFSDIELAAIPFNTLADHYGERLAREQLALEHESYEMAEARFRK MFERQLKAGEVADNAAAKPLITTLLPKMIARINDWFEEVKAKRGKRPIAFQFL QEIKPEAVAYITIKTTLACLTSADNTTVQAVASAIGRAIEDEARFGRIRDLEA KHFKKNVEEQLNKRVGEVYKKAFMQVVEADMLSKGLLGGEAWSCWHKEDSIEV GVRCIEMLIESIGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRNDKARKSRRLSLEFMLFQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGLKAGAGQWLAYSVTRSVLKRSVMT LAYGSKEFGFRQQVLEDTIQPAIDSGKGLMFIQPNQAAGYMAHLIWESVSVTV VAAVEAMNWLKSAAKLLAAEVKDKKIGEILRKRCAVHWVTPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVREIMVDIYESCDVLADFYDQ FADQLHESQLDKMPALPAKGNLNLRDILESDFAFAS | 65 |
| G47A, G884P | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWIGITGSGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMENPQCNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQPAIDSGKGLMFTQPNCAAGYMAHLIWESVSVTV VAAVEAMNWLKSAAKLLAAEVKDKKTGEILRKRCAVHWVTPDGFPVWQEYKKP IQTRLNLMFLGQFRLQPTINTNKESEIDAHKQESGIAPNEVHSQDGSHLRKTV VWAHEKYGIESFALIHDSEGTIPADAANLFKAVREIMVDTYESCDVLADFYDQ FADQLHESQLDKMPALPAKGNLNLRDILESDFAFAP | 66 |
| G47A, G884P, K387N | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFCRIRDLEA REFKKNVEEQLNKRVGHVYKKAFMQVVEADMLSKGLLGGEAWSSWHKEPSIHV GVRCIEMLIESTGMVSLHRQNAGVVGQDSETIELAPEYAEAIATRAGALAGIS PMFQPCVVPPKPWTGITGCCYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRNDKARKSRRISLEFMLEQANKFANHKAIWFPYNMDWRG RVYAVSMENPQCNDMTKGLLTLAKGKPIGKEGYYWLKIHCANCAGVDKVPFPE RIKFTEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNEVHSQDGSHLRKTV VWAHEKYGIESFALIHDSFGTIPADAANLFKAVRETMVDTYESCDVLADFYDQ FADQLHESQLDKMPALPAKGNLNLRDILESDPAPAP | 67 |
| G47A, D653W, G884 | MNTINIAKNDFSDIELAAIPFNTLADHYGERLAREQLALEHESYEMAEARFRK MFERQLKAGEVADNAAARPLITTLLPKMIARINDWPEEVKARRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKPRARKSRRISLEFMLEQANKFANHKAIWFRYNMDERG RVYAVSMENPQGNDMIKGLLTLAKGKPIGKEGYYWLKIHGANCAGVDKVPFPE RIKFIEENHENIMACAKSPLENTWWAEQDSPFCFLAPCFEYAGVQHHOLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYCSKEPCFRQQVLEWTIQPAIDSCKCLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKCSEIDAHKQESGIAPNEVHSQDGSHLRKTV VWAHEKYGIESFALIHDSECTIPADAANLFKAVRETMVDTYESCDVLADFYDQ FADQLHESQLDKMPALPAKGNLNLRDILESDFAFAG | 68 |

TABLE 6-continued

Additional Multi-Substitution Variants

| RNA Polymerase Variants | Amino Acid Sequence | SEQ ID NO |
|---|---|---|
| G47A, D653W, K387N, G884 | MNTINIAKNDFSDIELAAIPENTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRALEDEARYGRTRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRNDKARKSRRISLEFMLEQANKFANHKAIWFPYNMDWRG RVYAVSMENPQGNDMTKGLLTLAKGKPIGREGYYWLKIRGANCAGVDKVPYPE RIKFIEENHENIMACAKSPLENTWWAEQDSPFCFLAFCFEYAGVQHHGLSYNC SLPLAPPGSCSGIQHFSAMLRDEVGGRAVNLLPSETVQDIYGIVAKKVNEILQ ADAINGTDNEVVTVTDENTGEISEKVKLGTKALAGQWLAYGSVTPSVKRSVMT LAYGSKEFGFRQQVLEWTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTININKESEIDAHKQESGIAPNFVHSQDGSHLRKTV VWAHEKYGIESFALIHDSEGTIPADAANLFKAVRETMVDTYESCDVLADFYDQ FADQLHESQLDKMPALPAKCNLNLRDILESDFAFAG | 69 |
| G47A, D653W, G884T | MNTINIAKNDFSDIELAAIPFNTLADHYGERLAREQLALEHESYEMAEARFRK MFERQLKAGEVADNAAAKPLITTLLPKMIARINDWFEEVKAKRGKRFIAFQFL QEIKPEAVAYITIKTTLAGLISACNTIVQAVASAIGRAIEDEARFGRIRDLEA KHFKKNVEEQLNKKVGHVYKKAYMQVVEADMLSKGLLGGEAWSSWHKEDSIHV GVRCIEMLIESTGMVSLHRQNAGVVGQDSETIELAFEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMFNPQGNDMTKGILTLAKGKPIGKEGYYWLKIHGANCAGVDKVPFPE RIKFIEENHENIMACAKSPLENTWWAEQDSPFCFLAFGFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGIKALAGQWLAYCVTRSVIKRSVMT LAYGSKEFGFRQQVLEWTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQFRLQPTININKCSEIDAHKQESGIAPNFVHSQDCSALRKTV VWAHEKYGIESFALIHDSEGTIPADAANLFKAVRETMVDIYESCDVLADFYDQ FADQLHESQLDKMPALPAKGNLNLRDILESDFAFAT | 70 |
| G47A, D653W, G884T, K387N | MNTINIAKNDFSDIELAAIPFNTLADHYGERLAREQLALEHESYEMAEARFRK MFERQLKAGEVADNAAAKPLITTLLPKMIAKINDWFEEVKAKRGKRPTAFQFL QEIKPEAVAYITIKTTLAGLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKFWTGITGSGYWANGRRFLALVRTHSKKALMRYEDVYMPEVYK AINIAQNTAWKINKKVLAVANVIIKWKHCPVEDIPAIEREELPMKPEDIDMNP EALTAWKRAAAAVYRNDKARKSRRISLEFMLEQANKFANHKAIWFPYNMDWRG RVYAVSMFNPQGNDMIKGILTLAKGKPIGKEGYYWLKIHGANCAGVDKVPFFE RIKFIEENHENIMACAKSPLENTWWAEQDSPFCFLAFCFEYAGVQHHGLSYNC SLPLAYDGSGSGIQHFSAMLRDEVGGRAVNILPSEIVQDIYGIVAKKVNEILQ ADAINGTDNEVVTVTDENTGEISEKVKLGTKAIAGQWLAYSVTRSVIHRSVMT LAYCSKEFCFRQQVLEWTIQPAIDSCKCLMFTQPNQAACYMAKLIWESVSVTV VAAVEAMNWLKSAAKLLAAEVKDKKTGEILRKRCAVHWVTPDGFPVWQEYKKP IQTRLNLMFLGQFRLQPTININKDSEIDAHKQESGIAFNFVHSQDGSHLRKTV VWAHEKYGIESFALIHDSFCTIDADAANLFKAVRETMVDTYESCDVLADFYDQ FADQLHESQLDKMPALPAKGNLNLRDILESDFAFAT | 71 |
| G47A, D653W, G884S | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLAGLISADNTTVQAVASAIGRAIEDEARFGRIRDLEA KHFKKNVEEQLNKRVCHVYKKAFMQVVEADMLSKCLLCCEAWSSWHKEDSIHV GVRCIEMLIESTGMVSLHRQNAGVVGQDCETIELAFEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKREDIDMNP EALTAWKRAAAAVYRKDKARKSRRISLEFMLEQANKFANHKAIWFFYNMDWRG RVYAVSMFNPQGNDMTKGILTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQWLAYGVTRSVTKRSVMT LAYGSKEFGFRQQVLEWTIQPAIDSGKGLMFTQFNQAAGYMAHLIWESVSVTV VAAVEAMNWLKSAAKLLAAEVKDKKTGEILRKRCAVHWVTPDGFPVWQEYKKF IQTRLNLMFLGQYKLQPTINTNKDSEIDAHKQESGIAPNYVHSQDGSHLKKTV VWAHEKYGIESFALIHDSEGTIPADAANLFKAVRETMVDTYESCDVLADFYDQ FADQLHESQLDKMPALPAKCNLNLRDILESDFAFAS | 72 |

TABLE 6-continued

Additional Multi-Substitution Variants

| RNA Polymerase Variants | Amino Acid Sequence | SEQ ID NO |
|---|---|---|
| G47A, D653W, G884S, K387N | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLAGLTSADNTIVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRNDKARKSRPTSLEFMLEQANKFANHKAIWETYNMDWRG RVYAVSMENPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEWTIQPATESGKGLMFTQPNQAAGYMAKLIWESVSVTV VAAVEAMNWLKSAAKLLAAEVKDKKTGEILRKRCAVHWVTPDGETVWQEYKKP IQTRLNLMELGQFRLQPTINTNKCSEIDAHKQESGIAPNFVHSQDGSHLRKTV VWAHEKYGIESFALIHDSFGTIPADAANLFKAVRETMVDTYESCDVLADFYDQ FADQLHESQLDKMFALFAKGNLNLRDILESDFAFAS | 73 |
| G47A, D653W, G884P | MNTINIAKNDFSDIELAAIPENTLADHYGERLAREQLALEHESYEMAEARERK MFERQLKAGEVADNAAAKPLITTLLPKMIARINDWEEEVKAKRGKRPIAFQFL QEIKFEAVAYITIKTILACLTSADNTIVQAVASAIGRAIEDEARFGRIRDLEA KHFKKNVEEQLNKRVCHVYKKAFMQVVEADMLSKGLLGGEAWSSWHKEDSIHV CVKCIEMLIESIGMVSLHRQNAGVVGQDSETIELAPEYAEAIAIRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRKIISLEFMLEQANKFANHKAIWFRYNMDWRG RVYAVSMENPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEWTIQPAICSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQFTINTNKCSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAP | 74 |
| G47A, D653W, G884P, K387N | MNTINIAKNDFSDIELAAIFFNTLADHYGERLAREQLALEHESYEMAEARFRK MFERQLKAGEVADNAAAKPLITTLLPKMIARINDWFEEVKAKRGKRPTAFQFL QEIKPEAVAYIIIKTILACLTSADNITVQAVASAIGRAIEDEARYGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWIGITGSGYWANGRRPLALVRTHSKKALMRYEDVYMPEVYK AINIAQNTAWKINKKVLAVANVIIKWKHCFVEDIPAIEREELPMKPEDIDMNF EALTAWKRAAAAVYRNDKARKSRPTSLEFMLEQANKFANHKAIWFPYNMDWRG RVYAVSMFNPQCNDMTKCLLTLAKGKRIGKEGYYWLKIHCANCACVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINCTDNEVVTVTDENTCEISENVKLGTKALACQWLAYSVIRSVTKRSVMT LAYGSKEFGFRQQVLEWTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQFRLQPTININKDSEIDAHKQESGIAPNFVHSQDGSHLRKTV VWAHEKYGIESFALIHDSEGTIPADAANLFKAVRETMVDTYESCDVLADFYDQ FADQLHESQLDKMPALPAKGNLNLRDILESDFAFAP | 75 |
| G47A, D653T, G884 | MNTINIAKNDFSDIELAALPFNTLADHYGERLAREQLALEHESYEMAEARYRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHYKKNVEEQLNKRVCHVYKKAYMQVVEACMLSKCLLCCEAWSSWHKEDSIHV GVRCIEMLIESTGMVSLHRQNAGVVGQDSETIELACEYAEAIATRAGALAGIS PMFQPCVVPPKPWTGITGGGYWANGRRPLALVRTHSKKALMRYEDVYMPFVYK AINIAQNTAWKINKKVLAVANVITKWKHCPVEDIPAIEREELPMKPEDIDMNP EALTAWKRAAAAVYRKDKARKSRPTSLEFMLEQANKFANHKAIWFFYNMDWRG RVYAVSMENPQGNDMTKGLLTLAKGKPIGKEGYYWLKIHGANCAGVDKVPFPE RIKFTEENHENIMACAKSPLENTAWAEQCSPYCYLAYCFEYAGVQHHCLSYNC SLPLAFDGSCSGIQHFSAMLRDEVGGRAVNLLFSETVQDIYGIVAKKVNEILQ ADAINGTDNEVVTVTDENTGEISEKVKLGTKALAGQWLAYSVTRSVTKRSVMT LAYGSKEFGFRQQVLETTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTININKCSEIDAHKQESGIAPNFVHSQDCSHLRKTV VWAHEKYGIESFALIHDSFCTIPADAANLFKAVRETMVDTYESCDVLADFYDQ FADQLHESQLDKMPALPAKGNLNLRDILESDFAFAG | 76 |

TABLE 6-continued

Additional Multi-Substitution Variants

| RNA Polymerase Variants | Amino Acid Sequence | SEQ ID NO |
|---|---|---|
| G47A, D653T, K387N, G884 | MNTINIAKNDFSDIELAAIPFNTLADHYCERLAREQLALEHESYEMAEARFRK MFERQLKAGEVADNAAARPLITTLLPKMIARINDWFEEVKARRGKRPTAFQYL QEIKPEAVAYITIKTTLACLISADNTTVQAVASAIGRAIEDEARFGRIRDLEA KHFKKNVEEQLNKRVCHVYKKAFMQVVEADMLSKGLLGGEAWSSWHKEDSIHV GVRCIEMLIESIGMVSLHRQNAGVVGQDSETIELADEYAEAIAIRAGALAGIS PMFQPCVVPPKFWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRNDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQWLAYSVTRSVTKRSVMT LAYGSKEFGFRQQVLETTIQPAIDSGKGLMFTQPNQAAGYMAKLIWESVSVTV VAAVEAMNWLKSAAKLLAAEVKDKKTGETLRKKCAVHWVTPDGETVWQEYKKP IQTRLNLMFLGQFRLQPTININKDSEIDAHKQESGIAPNFVHSQDCSHLRKTV VWAHEKYGIESFALIHDSFGTIPADAANLFKAVREGMVDTYESCDVLADFYDQ FADQLHESQLDKMPALPAKGNLNLRDILESDFAFAG | 77 |
| G47A, D653T, G884T | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITCSCYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFDYNMDWRG RVYAVSMYNPQGNDMTKGLLTLAKCKPIGRECYYWLKIHCANCAGVDKVPYPE RIKFIEENHENIMACAKSPLENTWWAEQDSPFCFLAFCFEYAGVQHHGLSYNC SLPLAFDCSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLETTIQPAICSGKGLMFTQPNGAAGYMAHLIWESVSVTV VAAVEAMNWLKSAAKLLAAEVKDKKTGEILRKRCAVHWVTPDGFPVWQEYKKP IQTRLNLMFLGQFRLQPTININKDSEIDAHKQESGIAPNFVHSQDGSHLRKTV VWAHEKYGIESFALIHDSEGTIPADAANLFKAVREDMVDTYESCDVLADFYDQ FADQLHESQLDKMPALPAKCNLNLRDILESDFAFAT | 78 |
| G47A, D653T, G884T, K387N | MNTINIAKNDFSDIELAAIPFNTLADHYGERLAREQLALEHESYEMAEARFRK MFERQLKAGEVADNAAAKPLITTLLPKMIARINDWFEEVKAKRCKRPIAFQFL QEIKPEAVAYITIKTTLACLTSADNTTVQAVASAIGRAIEDEARFGRIRDLEA KHFKKNVEEQLNKRVCHVYKKAFMQVVEADMLSKGLLGGEAWSSWHKEDSIHV CVRCIEMLIESTCMVSLHRQNAGVVCQDSETIELAPEYAEAIATRACALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRNDKARKSRRISLEFMLEQANKFANHKAIWFRYNMDWRG RVYAVSMFNPQGNDMIKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDCSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLETTIQPAIDSGKGLMFTQPNQAAGYMAKLIWESVSVTV VAAVEAMNWLKSAAKLLAAEVKDEKTGEILRKRCAVHWVTPDGETVWQEYKKP IQTRLNLMFLGQFRLQPTININKCSEIDAHKQESGIAPNFVHSQDGSHLRKTV VWAHEKYGIESFALIHDSFGTIPADAANLFKVARETMVDTYESCDVLADFYDQ FADQLHESQLDKMPALPAKGNLNLRDILESDFAFAT | 79 |
| G47A, D653T, G884S | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVCHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYACVQHHCLSYNC SLPLAFDCSCSGIQHFSAMLRDEVGGRAVNLLPSETVQDIYGIVAKKVNEILQ ADAINGTDNEVVTVTDENTGEISEKVKLGTKATAGQWLAYGVTRSVTKRSVMT LAYCSKEFGFRQQVLETTIQPAIDSGKCLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAS | 80 |

TABLE 6-continued

Additional Multi-Substitution Variants

| RNA Polymerase Variants | Amino Acid Sequence | SEQ ID NO |
|---|---|---|
| G47A, D653T, G884S, K387N | MNTINIAKNDFSDIELAAIPENTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV CVRCIEMLIESTCMVSLHRQNACVVCQDSETIELAPEYAEAIATRACALAGIS PMEQPCVVPPKPWTGITGGGYWANGRRPLALVRTHSKKALMRYEDVYMPEVYK AINIAQNTAWKINKKVLAVANVITKWKHCPVEDTPAIEREELPMKPEDIDMNP EALTAWKRAAAAVYRNDKARKSRPTSLEFMLEQANKFANHKAIWFPYNMDWRG RVYAVSMENPQGNDMIKGILTLAKGKPIGKEGYYWLKIHGANCAGVDKVPFPE RIKFIEENHENIMACAKSPLENTWWAEQDSPFCFLAFCFEYAGVQHHCLSYNC SLPLAFDCSCSGIQHFSAMLRDEVGGRAVNLLPSETVQDIYGIVAKKVNEILQ ALAINGTDNEVVTVTDENTGEISEKVKLGCKATAGQWLAYSVTRSVCKRSVMT LAYCSKEFGFRQQVLETTIQPAIDSGRCLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALFAKCNLNLRDILESDFAFAS | 81 |
| G47A, D653T, G884P | MNTINIAKNDFSDIELAAIFFNTLADRYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHRRKKNVEEQLNKRVGHVYKKAYMQVVEADMLSKGLLGGEAWSSWHKLESIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDTPAIEREELPMKPEDIDMNP EALTAWKRAAAAVYRKDKARKSRRTSLEFMLEQANKFANHKAIWFPYNMDWRG RVYAVSMFNPQCNDMTKGLLTLARCKPIGKEGYYWLKIHCANCACVDKVPFPE RIKFLEENHENIMACAKSPLENTWWAEQNSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTCEISEKVKLGTKATAGQWLAYGVTRSVTKRSVMT LAYGSKEFGFRQQVLETTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDCSHLRKTV VWAHEKYGIESFALIHDSFGTIPADAANLFKAVRETMVDTYESCDVLADFYDQ FADQLHESQLDKMPALPAKGNLNLRDILESDFAFAP | 82 |
| G47A, D653T, G884P, K387N | MNTINIAKNDFSDIELAAIPPNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSELIELAPEYAEATATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRNDKARKSRRISLEFMLEQANKFANHKAIWFPYNMDWRG RVYAVSMENPQGNDMTKGLLTLAKGKPIGKEGYYWLKIHGANCAGVDKVPFPE RIKFIEENHENIMACAKSPLENTWWAEQDSPFGFLAFCFEYAGVQHHGLSYNC SLPLAFDGSCSGIQHFSAMLRDEVGGRAVNLLYSETVQDIYGIVAKKVNEILQ ADAINGTDNEVVTVTDENTGEISEKVKLGTKALAGQWLAYGVTRSVTKRSVMT LAYCSKEFCFRQQVLETTIQPAIDSCKCLMFTQPNQAACYMAKLIWESVSVTV VAAVEAMNWLKSAAKLLAAEVKDKKTGETLRKRCAVHWVTPDGFPVWQEYKKP IQTRLNLMFLGQFRLQPTININKCSEIDAHKQESGIAPNEVHSQDGSHLRKTV VWAHEKYGIESFALIHDSEGTIPADAANLFKAVREIMVDTYESCDVLADFYDQ FADQLHESQLDKMPALPAKGNLNLRDILESDFAFAP | 83 |
| G47A, D653K, G884 | MNTINIAKNDFSDIELAAIFFNTLADHYGERLAREQLALEHESYEMAEARFRK MFERQLKAGEVADNAAAKPLITTLLPKMIARINDWFEEVKAKRGKRPIAFQFL QEIKPEAVAYITIKTTLACLTSADNTTVQAVASAIGRAIEDEARYGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCFVEDIFAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIFENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTESVTKRSVMT LAYGSKEFGFRQQVLEKTIQPAIESGKGLMFIQPNQAAGYMAKLIWESVSVTV VAAVEAMNWLKSAAKLLAAEVKDKKTGEILRKRCAVHWVTPDCFPVWQEYKKP IQTRLNLMFLGQFKLQPTINTNKESEIDAHKQESGIAPNFVHSQDGSHLRKTV VWAHEKYGIESFALIHDSEGTIPADAANLFKAVRETMVDTYESCDVLADFYDQ FADQLHESQLDKMPALPAKGNLNLRDILESDFAFAG | 84 |

TABLE 6-continued

Additional Multi-Substitution Variants

| RNA Polymerase Variants | Amino Acid Sequence | SEQ ID NO |
|---|---|---|
| G47A, D653K, K387N, G884 | MNTINIAKNDFSDLELAAIPFNILADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDTPAIEREELPMKPEDIDMNP<br>EALTAWKRAAAAVYRNDKARKSRRISLEFMLEQANKFANHKAIWFPYNMDWRG<br>RVYAVSMENPQGNDMIKGLLTLAKGKPIGKEGYYWLKIHGANCAGVDKVPFPE<br>RIKEIEENHENIMACAKSPLENTAWAEQDSPYCYLAYCFEYAGVQHHGLSYNC<br>SLFLAFDGSCSGIQHFSAMLRDEVGGRAVNLLTSEIVQDIYGIVAKKVNEILQ<br>ADAINGIDNEVVIVIDENIGEISEKVKLGTKALAGQWLAYSVTRSVTKRSVMT<br>LAYGSKEFGFRQQVLEKTIQPAIDSGKGLMFTQPNQAAGYMAKLIWESVSVTV<br>VAAVEAMNWLKSAAKLLAAEVKDKKTGEILRKRCAVHWVTPDGFFVWQEYKKP<br>IQTRLNLMFLGQFRLQPTINTNKDSEIDAHKQESGIAPNFVHSQDGSHLRKTV<br>VWAHERYGIESFALIHDSEGTIPADAANLFKAVRETMVDTYESCDVLADFYDQ<br>FADQLHESQLDKMPALFAKGNLNLRDILESDFAFAG | 85 |
| G47A, D653K, G884T | MNTINIAKNDFSDIELAAIPFNTLADHYGERLAREQLALEHESYEMAEARFRK<br>MFERQLKAGEVADNAAAKPLITILLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVEDTPAIEREELPMKREDIDMNF<br>EALTAWKRAAAAVYRNDKARKSRRISLEFMLEQANKFANHKAIWFPYNMDWRG<br>RVYAVSMENPQGNDMIKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFGGSCSGIQHFSAMLRDEVGGRAVNLLPSETVQDIYGIVAKKVNEILQ<br>ADAINGTDNEVVTVTDGEISEKVKLGTKALAGQWLAYSVTRSVTKRSVMT<br>LAYGSKEFGFRQQVLEKTIQPAIDSGKCLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLGQFRLQPTINTNKDSEIDAHKQESGIAPNFVHSQDGSNLRKTV<br>VWANEKYGIESFALINDSEGTIFADAANLFKAVREIMVDIYESCDVLADFYDQ<br>FADQLHESQLDKMPALPAKGNLNLRDILESDFAFAT | 86 |
| G47A, D653K, G884T, K387N | MNTINIAKNDFSDIELAAIPFNTLADHYGERLAREQLALEHESYFMAEARFEK<br>MFERQLKAGEVADNAAAKPLITITLLPKMIARINDWFEEVKAKRGKRPIAFQFL<br>QEIKPEAVAYITIKTTLACLTSADNTTVQAVASAIGRAIEDEARFGRIRDLEA<br>KHFKKNVFEQLNKEVGHVYKKAFMQVVFADMLSKGLLGGFAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRNDKARKSRRISLEFMLEQANKFANHKAIWFPYNMDWRG<br>RVYAVSMENPQGNDMIKGLLTLAKGKPIGKEGYYWLKIHGANCAGVDKVPFPE<br>RIKFIEENHENIMACAKSPLENTWWAEQDSPFCFLAFGFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGYKALAGQWLAYSVIRSVTKRSVMT<br>LAYGSKEFGFRQQVLEKTIQPAIDSGKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLGQFRLQPTINTNKCSEIDAHKQESGIAPNEVHSQDGSHLRKTV<br>VWAHEKYGIESFALIEDSFGTIPADAANLFKAVRETMVDTYESCDVLADFYDQ<br>FADQLHESQLDKMPALPAKGNLNLRDILESDFAFAT | 87 |
| G47A, D653K, G884S | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSACNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITCCCYWANCRRPLALVRTHSKKALMRYEDVYMPEVYK<br>AINIAQNTAWKINKKVLAVANVITKWKHCPVEDIPAIEREELPMKPEDIDMNY<br>EALTAWKRAAAAVYRKDKARKSRRISLEFMLEQANKFANHKAIWFPYNMDWRG<br>RVYAVSMFNPQCNDMTKGLLTLAKGKPIGKECYYWLKIHCANCAGVDKVPFPE<br>RIKFIEENHENIMACAKSPLENTWWAEQDSPFCFLAFCFEYAGVQHHGLSYNC<br>SLPLAFDGSGSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYGSKEFGFRQQVLEKTIQPAIESGKGLMFIQPNQAAGYMAHLIWESVSVTV<br>VAAVEAMNWLKSAAKLLAAEVKDKKTGEILRKRCAVHWVTPDGFPVWQEYKKP | 88 |

TABLE 6-continued

Additional Multi-Substitution Variants

| RNA Polymerase Variants | Amino Acid Sequence | SEQ ID NO |
|---|---|---|
| | IQTRLNLMFLGQFRLQPTINTNKCSEIDAHKQESGIAPNEVHSQDGSHLRKTV<br>VWAHEKYGIESFALIHDSECTIPADAANLFKAVRETMVDTYESCDVLADFYDQ<br>FADQLHESQLDKMPALPAKGNLNLRDILESDFAFAS | |
| G47A, D653K, G884S, K387N | MNTINIAKNDFSDIELAAIPFNTLADHYGERLAREQLALEHESYEMAEARFRK<br>MFERQLKAGEVADNAAAKPLITTLLPKMIAKINDWFEEVKAKRGKRPTAKQEL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIEV<br>GVRCIEMLIESTGMVSLHKQNAGVVGQDSETIELAPEYAEAIATRAGALAGIS<br>PMFQPCVVPPKPWTGITGSSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRNDKARKSRRTSLEFMLEQANKFANHKAIWFPYNMDWRG<br>RVYAVSMENPQGNDMTKGLLTLAKGKPIGKEGYYWLKIHGANCAGVDKVPFFE<br>RIKFIEENHENIMACAKSPLENTWWAEQDSPFCFLAFGFEYAGVQHHGLSYNC<br>SLRLAFDCSCSGIQHESAMERDEVGGRAVNEEPSETVQDIYGIVAKKVNEILQ<br>ADAINGTDNEVVTVTDENTGEISEKVKLGTKALAGQWLAYSVTRSVTKRSVMT<br>LAYCSKEFGFRQQVLEKTIQPAIDSCKCLMFTQPNQAAGYMAKLIWEGVSVTV<br>VAAVEAMNWLKSAAKELAAEVKDKKTGEILKKRCAVHWVIPDGETVWQEYKKP<br>IQTRLNLMFLGQFRLQPTINTNKESEIDAHKQESGIAPNEVHSQDGSHLRKTV<br>VWAHEKYCIEGFALIHDSFGTIPADAANLFKAVRETMVDTYESCDVLADFYDQ<br>FADQLHESQLDKMPALPAKGNLNLRDILESDFAFAS | 89 |
| G47A, D653K, G884P | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLAGLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRGIEMLIESTGMVSLHRQNAGVVGQDSETIELAPEYAEAIATRAGALAGIS<br>PMFQPCVVPPKPWTGITCSCYWANGRRPLALVRTHSKKALMRYEDVYMPEVYK<br>AINIAQNTAWKINKKVLAVANVITKWKHCPVEDTPAIEREELPMKPEDIDMNP<br>EALTAWKRAAAAVYRKDKARKSRRISLEFMLEQANKFANHKAIWFPYNMDWRG<br>RVYAVSMYNYQCNDMIKGLLTLAKGKPIGKECYYWLKIHCANCACVDKVYYPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSEIVQDIYGIVAKKVNEILQ<br>ADAINGTDNEVVTVTDENTGEISEKVKLGTKALAGQWLAYGVTRSVTKRSVMT<br>LAYGSKEFGFRQQVLEKTIQPAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMYLGQFRLQPTINTNKDSEIDAHKQESGIAPNFVHSQDCSHLRKTV<br>VWAHEKYGIESFALIHDSFGTIPADAANLFKAVREIMVDTYESCDVLADFYDQ<br>FADQLHESQLDKMPALPAKGNLNLRDILESDFAFAP | 90 |
| G47A, D653K, G884P, K387N | MNTINIAKNDFSDIELAAIPFNTLADHYGERLAREQLALEHESYEMAEARFRK<br>MFERQLKAGEVADNAAAKPLITTLLPKMIARINDWEEEVKAKRGKRPIAFQFL<br>QEIKPEAVAYITIKTTLACLTSACNTTVQAVASAIGRAIEDEARFGRIRDLEA<br>RHYKRNVEEQLNKRVGHVYKKAYMQVVEADMLSRGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRNDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGIDNEVVTVTDENTGEISEKVKLGTKALAGQWLAYGVTRSVTKRSVMT<br>LAYGSKEFGFRQQVLEKTIQPAIDSGKGLMFTQPNQAAGYMAHLIWESVSVTV<br>VAAVEAMNWLKSAAKLLAAEVKDKKTGEILRKRCAVHWVTPDGFEWWQEYKKP<br>IQTRLNLMFLGQFRLQPTINTNKDSEIDAHKQESCIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAP | 91 |
| G47A, K387S, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESIGMVSLHRQNAGVVGQDSEIIELAPEYAEAIAIRAGALAGIS<br>PMFQPCVVPPKFWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRSDKARKSRPLSEYMLEQANKFANHKAIWYPYNMDERG<br>RVYAVSMFNPQGNDMIKGLLTLAKGKPIGKEGYYWLKIHGANCAGVDKVPFFE<br>RIKFIEENHENIMACAKSPLENTWWAEQDSPFCFLAFCFEYAGVQHHGLSYNC<br>SLPLAFDQSCSGIQHYSAMLRDEVGGRAVNLLPSEIVQDIYGIVARKVNEILQ<br>ADAINGTDNEVVTVTDENTGEISEKVKLGTKALAGQWLAYGVTRSVTKRSVMT | 92 |

TABLE 6-continued

Additional Multi-Substitution Variants

| RNA Polymerase Variants | Amino Acid Sequence | SEQ ID NO |
|---|---|---|
| | LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKESEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | |
| G47A, K387H, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVEDTPAIEREELPMKPEDIDMNP<br>EALTAWKRAAAAVYRHDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKRSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQYRLQPTINTNKESEIDAHKQESGIAPNYVHSQDGSHLRKTV<br>VWAHEKYGIESFALIHDSEGTIPADAANLFKAVRETMVDTYESCDVLADFYDQ<br>FADQLHESQLDKMPALPAKGNLNLRDILESDFAFAG | 93 |
| G47A, E350A, G884 | MNTINIAKNDFSDIELAAIPFNTLADHYGERLAREQLALEHESYEMAEARFRK<br>MEERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVADIPAIEREELPMKPEDIDMNP<br>EALTAWKRAAAAVYRKDKARKSRRISLEFMLEQANKFANHKAIWFPYNMDWRG<br>RVYAVSMFNPQCNDMTKGLLTLAKGKPIGKECYYWLKIHCANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKRSVMT<br>LAYGSKEFGFRQQVLEDTIQPAICSGKGLMFTQPNQAAGYMAKLIWESVSVTV<br>VAAVEAMNWLKSAAKLLAAEVKDEKTGEILRKRCAVHWVIDDGFPVWQEYKKD<br>IQTRLNLMFLGQFKLQPTININKCSEIDAHKQESGIAPNFVHSQDGSHLRKTV<br>VWAHEKYCIESFALIHDSFGTIPADAANLFKAVRETMVDIYESCDVLADFYDQ<br>FADQLHESQLDKMDALPAKGNLNLRDILESDFAFAG | 94 |
| G47A, E350A, K387S, G884 | MNTINIAKNDFSDIELAAIPFNTLADHYGERLAREQLALEHESYEMAEARFRK<br>MFERQLKAGEVADNAAAKPLITTLLPKMIARINDWEEEVKAKRGKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWIGITGSGYWANGKRPLALVRTHSKKALMRYEDVYMPEVYK<br>AINIAQNTAWKINKKVLAVANVITKWKHCPVADIPAIEREELPMKPEDIDMND<br>EALIAWKRAAAAVYRSDKARKSRFISLEFMLEQANKFANHKAIWFPYNMDWRG<br>RVYAVSMFNPQCNDMTKGLLTLAKGKPIGKECYYWLKIHCANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYCSKEFCFRQQVLEDTIQPAICSCKCLMFTQPNQAACYMAHLIWESVSVTV<br>VAAVEAMNWLKSAAKLLAAEVKDKKTGEILRKRCAVHWVTPDGFEWWQEYKKP<br>IQTRLNLMFLGQFRLQPTINTNKCSEIDAHKQESGIAPNFVHSQDCSHLRKTV<br>VWAHEKYCIESFALIHDSFCTIPADAANLFKAVRETMVDTYESCDVLADFYDQ<br>FALMLHESQLDKMPALPAKGNLNLRDILESDFAFAG | 95 |
| G47A, E350A, K387N, G884 | MNTINIAKNDFSDIELAAIFFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYLTIKTTLACLTSADNTTVQAVASAIGRAIEDEARFGRIRDLEA<br>KHFKKNVEEQLNKKVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMKYEDVYMPEVYK<br>AINIAQNTAWKINKKVLAVANVITKWKHCPVADIPAIEREELPMKPEDIDMND<br>EALTAWKRAAAAVYRHDKARKSRRISLEFMLEQANKFANHKAIWFPYNMDWRC<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDCSCSCIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYGSKEFGFRQQVLEDTIQPAIDSGKGLMFTQPNQAAGYMAHLIWESVSVTV<br>VAAVEAMNWLKSAAKLLAAEVKDKKTGEILRKRCAVHWVTPDGFPVWQEYKKP | 96 |

TABLE 6-continued

Additional Multi-Substitution Variants

| RNA Polymerase Variants | Amino Acid Sequence | SEQ ID NO |
|---|---|---|
| | IQTRLNLMFLGQFKLQPTINTNKKSEIDAHKQESGIAPNFVHSQDGSHLKKTV<br>VWAHEKYGIESFALIHDSFGTIPADAANLFKAVRETMVDTYESCDVLADFYDQ<br>FADQLHESQLDKMDALPAKCNLNLRDILESDFAFAG | |
| G47A, E350A, K387N, G884 | MNIINIAKNDFSDIELAAIPFNILADHYGERLAREQLALEHESYEMAEAKFKK<br>MFERQLKAGEVADNAAAKPLITTLLPKMIARINDWFEEVKAKRCKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVADIPAIEREELPMKPEDIDMNP<br>EALTAWKKAAAAVYRNDKARKSRRISLEFMLEQANKFANHKAIWFFYNMDWRG<br>RVYAVSMFNPQGNDMTKGLLTLAKGKPIGKEGYYWLKIHGANCAGVDKVPFPE<br>RIKFIEENHENIMACAKSPLENTAWAEQDSPYCYLAYCFEYAGVQHHGLSYNC<br>SLPLAFDGSCSGIQHFSAMLRDEVGGRAVNLLPSETVQDIYGIVAKKVNEILQ<br>ADAINGIDNEVVTVTDENTGEISEKVKLGTKALAGQWLAYSVTRSVTKKSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVIDDGFPVWQEYKKD<br>IQTRLNLMFLGQFRLQPTINTNKCSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | 97 |
| G47A, E350K, G884 | MNTINIAKNDFSDIELAAIPFNTLADHYGERLAREQLALEHESYEMAEARFRK<br>MFERQLKAGEVADNAAAKPLITTLLPKMIARINDWEEEVKAKRGKRPIAFQFL<br>QEIKPEAVAYITIKTTLACLTSADNTTVQAVASAIGRAIEDEARFGRIRDLEA<br>KHYKKNVEEQLNKRVGHVYKKAYMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGPRPLALVRTHSKKALMRYEDVYMPEVYK<br>AINIAQNTAWKINKKVLAVANVITKWKHCPVKDIPAIEREELPMKPEDIDMNP<br>EALTAWKRAAAAVYRKDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGIDNEVVTVTDENTGEISEKVKLGTKALAGQWLAYGVTRSVTKRSVMT<br>LAYGSKEFGFRQQVLEDTIQPAICSGKGLMFTQPNQAAGYMAHLIWESVSVTV<br>VAAVEAMNWLKSAAKLLAAEVKDKKTGEILRKRCAVHWVIPDGFEWWQEYKKP<br>IQTRLNLMFLGQFRLQPTINTNKDSEIDAHKQESCIAPNFVHSQDGSHLRKTV<br>VWAHEKYGIESFALIHDSFGTIPADAANLFKAVRETMVDTIYESCDVLADFYDQ<br>FADQLHESQLDKMPALPAKGNLNLRDILESDFAFAG | 98 |
| G47A, E350K, K387S, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESIGMVSLHRQNAGVVGQDSETIELAPEYAEAIAIRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVKDTPAIEREELPMKPEDIDMNP<br>EALTAWKRAAAAVYRSDKARKSRPLSLEYMLEQANKFANHKAIWYPYNMDERG<br>RVYAVSMFNPQGNDMIKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHYSAMLRDEVGGRAVNLLPSETVQDIYGIVARKVNEILQ<br>ADAINGTDNEVVTVTDENTGEISEKVKLGTKALAGQWLAYGVTRSVTKRSVMT<br>LAYGSKEFGFRQQVLEDTIQPAICSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKESEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | 99 |
| G47A, E350K, K387N, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVKDIPAIEREELPMKPEDIDMNP<br>EALTAWKRAAAAVYRHDKARKSRRISLEFMLEQANKFANHKAIWFDYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ | 100 |

TABLE 6-continued

Additional Multi-Substitution Variants

| RNA Polymerase Variants | Amino Acid Sequence | SEQ ID NO |
|---|---|---|
| | ADAINGTDNEVVTVTDENTGEISEKVKLGTKALAGQWLAYSVTRSVTKRSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQYRLQPTINTNKESEIDAHKQESGIAPNYVHSQDGSHLRKTV<br>VWAHEKYGIESFALIHDSEGTIPADAANLFKAVRETMVDTYESCDVLADFYDQ<br>FADQLHESQLDKMPALPAKGNLNLRDILESDFAFAG | |
| G47A, E350K, K387N, G884 | MNTINIAKNDFSDIELAAIPFNTLADHYGERLAREQLALEHESYEMAEARFRK<br>MEERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVKDIPAIEREELPMKPEDIDMNP<br>EALTAWKRAAAAVYRNDKARKSRRISLEFMLEQANKFANHKAIWFPYNMDWRG<br>RVYAVSMENPQCNDMTKGLLTLAKCKPIGKECYYWLKIHGANCACVDKVPFPE<br>RIKFIEENHENIMACAKSPLENTWWAEQDSPFCFLAFCFEYAGVQHHCLSYNC<br>SLPLAFDQSCSGIQHFSAMLRDEVGGRAVNELPSETVQDIYGIVAKKVNEILQ<br>ADAINCTDNEVVTVTDENTGEISEKVKLGTKALACQWLAYSVTRSVTKRSVMT<br>LAYCSKEFGFRQQVLEDTIQPAIDSGKCLMFTQPNQAAGYMAKLIWESVSVTV<br>VAAVEAMNWLKSAAKELAAEVKDEKTGEILRKRCAVHWVTPDGFPVWQEYKKP<br>IQTRLNLMFLGQFRLQPTINTNKCSEIDAHKQESGIAPNFVHSQDCSHLRKTV<br>VWAHEKYCIESFALIHDSFCTIPADAANLFKAVRETMVDIYESCDVLADFYDQ<br>FADQLHESQLDKMPALPAKGNLNLRDILESDFAFAG | 101 |
| G47A, E350N, G884 | MNTINIAKNDFSDIELAAIPFNTLADHYGERLAREQLALEHESYEMAEARFRK<br>MFERQLKAGEVADNAAAKPLITTLLPKMIARINDWEEEVKAKROKRPIAFQFL<br>QFIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWIGITGSGYWANGRRPLALVRTHSKKALMRYEDVYMPEVYK<br>AINIAQNTAWKINKKVLAVANVITKWKHCPVNDIPAIEREELPMKPEDIDMND<br>EALTAWKRAAAAVYRKDKARKSRRLSLEFMLEQANKFANHKAIWFPYNMDWRG<br>RVYAVSMENPQGNDMTKGLLTLAKGKPIGKEGYYWLKIHGANCAGVDKVPFPE<br>RIKFIEENHENIMACAKSPLENTWWAEQDSPFCFLAFCFEYACVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYCSKEFCFRQQVLEDTIQPAIDSCKCLMFTQPNQAACYMAHLIWESVSVTV<br>VAAVEAMNWLKSAAKLLAAEVKDKKTGEILRKRCAVHWVTPDGFEWWQEYKKP<br>IQTRLNLMFLGQFRLQPTINTNKCSEIDAHKQESGIAPNEVHSQDGSHLRKTV<br>VWAHEKYGIESFALIHDSFGTIPADAANLFKAVREIMVDTYESCDVLADFYDQ<br>FAIMLHESOLDKMPALPAKGNLNLRDILESDFAFAG | 102 |
| G47A, E350N, K387S, G884 | MNTINIAKNDFSDIELAAIFFNTLADHYGERLAREQLALEHESYEMAEARFRK<br>MFERQLKAGEVADNAAAKPLITTLLPKMIARINDWFEEVKAKRGKRPTAFQFL<br>QETKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLAEVRTHSKKALMRYEDVYMPEVYK<br>AINIAQNTAWKINKKVLAVANVITKWKHCPVNDIPAIEREELPMKPEDIDMNP<br>EALTAWKRAAAAVYRSDKARKSRRISLEFMLEQANKFANHKAIWFPYNMDWRC<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSCIQHFSAMLRDEVCGRAVNLLPSETVQDIYGIVAKKVNEILQ<br>ADAINGTDNEVVTVTDENTGEISEKVKLGTKALAGQWLAYGVTRSVTKRSVMT<br>LAYGSKFFGFRQQVLEDTIQPAIDSGKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMYLCQYRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDRMPALPAKCNLNLRDILESDFAFAG | 103 |
| G47A, E350N, K387N, G884 | MNIINTAKNDFSDIELAAIPFNILADHYGERLAREQLALEHESYEMAEARFRK<br>MFERQLKAGEVADNAAAKPLITTLLPKMIARINDWFEEVKAKRCKRPTAFQFL<br>QEIKPEAVAYITIKTTLACLTSACNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNACVVCQDSETIELAPEYAEAIATRACALAGIS<br>PMFQPCVVPPKPWTGIGGGYWANGRRPLALVRTHSKKALMRYEDVYMPEVYK<br>AINIAQNTAWKINKKVLAVANVITKWKHCPVNDIPAIEREELPMKPEDIDMNP<br>EALTANKRAAAAVYRHDKARKSRRISLEFMLEQANKFANHKAIWERYNMDWRG<br>RVYAVSMENPQGNDMTKGLLTLAKGKPIGKEGYYWLKIHGANCAGVDKVPFFE<br>RIKFIEENHENIMACAKSPLENTAWAEQDSPECYLAYCFEYAGVQHHGLSYNC<br>SLPLAFDGSCSGIQHFSAMLRDEVGGRAVNELPSETVQDIYGIVAKKVNEILQ<br>ADAINGTDNEVVTVTDENTGEISEKVKLGTKALAGQWLAYSVTRSVTKRSVMT<br>LAYGSKEYGFRQQVLEDTIQPAIDSGKGLMFTQPNQAAGYMAKLIWESVSVTV | 104 |

TABLE 6-continued

Additional Multi-Substitution Variants

| RNA Polymerase Variants | Amino Acid Sequence | SEQ ID NO |
|---|---|---|
| | VAAVEAMNWLKSAAKELAAEVKDKKTGEILRKRCAVHWVTPDGFPVWQEYKKP IQTRLNLMFLGQFRLQPTINTNKDSEIDAHKQESGIAPNEVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | |
| G47A, E350N, K387N, G884 | MNTINIAKNDFSDIELAAIPFNTLADHYGERLAREQLALEHESYEMAEARFRK MFERQLKAGEVADNAAAKPLITTLLPKMIARINDWEEEVKAKRGKRPTAFQFL QEIKPEAVAYITIKTTLACLTSADNTTVQAVASAIGRAIEDEARFGRIRDLEA KHYKRNVEEQLNKRVGHVYKKAYMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITSGGYWANGRRPLALVRTHSKKALMRYEDVYMPEVYK AINIAQNTAWKINKKVLAVANVITKWKHCPVNDIPATEREELPMKPEDIDMNP EALTAWKRAAAAVYRNDKARKSRRISLEFMLEQANKFANHKAIWFPYNMDWRG RVYAVSMENPQGNDMIKGLLTLAKGKPIGKEGYYWLKIHGANCAGVDKVPFPE RIKFTEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQPAIDSGKGLMFTQPNQAAGYMAHLIWESVSVTV VAAVEAMNWLKSAAKLLAAEVKDKKTGEILRKRCAVHWVIPDGFEWWQEYKKP IQTRLNLMFLGQFRLQPTINTNKDSEIDAHKQESCIAPNEVHSQDGSHLRKTV VWAHEKYGIESFALIHDSFGTIPADAANLFKAVRETMVDIYESCDVLADFYDQ FADQLHESQLDKMPALPAKGNLNLRDILESDFAFAG | 105 |
| G47A, E350W, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSETIELAPEYAEAIAIRAGALAGIS PMFQPCVVPPKPWTGITGGGYWANGRRPLALVRTHSKKALMRYEDVYMPEVYK AINIAQNTAWKINKKVLAVANVITKWKHCPVWDIPAIEREELPMKPEDIDMNP EALTAWKRAAAAVYRKDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVARKVNEILQ ADAINGTDNEVVTVTDENTGEISEKVKLGTKALAGQWLAYGVTRSVTKRSVMI LAYGSKEFGFRQQVLEDTIQPAIDSGKGLMFTQPNQAAGYMAKLIWESVSVTV VAAVEAMNWLKSAAKLLAAEVKDKRIGEILRKRCAVHWVIPDGFPVWQEYKKP IQTRLNLMFLGQFRLQPTINTNKESEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 106 |
| G47A, E350W, K387S, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITSGSYWANGRRPLALVRTHSKKALMRYEDVYMPEVYK AINIAQNTAWKINKKVLAVANVITKWKHCPVWDIPAIEREELPMKPEDIDMNP EALTAWKRAAAAVYRSDKARKSRPISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQYRLQPTINTNKESEIDAHKQESGIAPNYVHSQDGSHLRKTV VWAHEKYGIESFALIHDSEGTIPADAANLFKAVRETMVDTYESCDVLADFYDQ FADQLHESQLDKMPALPAKGNLNLRDILESDFAFAG | 107 |
| G47A, E350W, K387N, G884 | MNTINIAKNDFSDIELAAIPFNTLADHYGERLAREQLALEHESYEMAEARFRK MEERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITSGGYWANGRRPLALVRTHSKKALMRYEDVYMPEVYK AINIAQNTAWKINKKVLAVANVITKWKHCPVWDIPAIEREELPMKPEDIDMNP EALTAWKRAAAAVYRHDKARKSRRISLEFMLEQANKFANHKAIWFPYNMDWRG RVYAVSMFNPQCNDMTKGLLTLAKGKPIGKECYYWLKIHCANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDEKTGEILRKRCAVHWVIDDGFPVWQEYKKD IQTRLNLMFLGQFKLQPTINTNKCSEIDAHKQESGIAPNFVHSQDGSHLRKTV | 108 |

TABLE 6-continued

Additional Multi-Substitution Variants

| RNA Polymerase Variants | Amino Acid Sequence | SEQ ID NO |
|---|---|---|
| | VWAHEKYCIESFALIHDSFGTIPADAANLFKAVRETMVDIYESCDVLADFYDQ FADQLHESQLDKMDALPAKGNLNLRDILESDFAFAG | |
| G47A, E350W, K387N, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSSGYWANGKRPLALVRTHSKKALMRYEDVYMPEVYK AINIAQNTAWKINKKVLAVANVITKWKHCPVWDIPAIEREELPMKPEDIDMND EALIAWKRAAAAVYRNDKARKSRFISLEFMLEQANKFANHKAIWFPYNMDWRG RVYAVSMFNPQCNDMTKGLLTLAKGKPIGKECYYWLKIHCANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSETVQDIYGIVAKKVNEILQ ADAINGIDNEVVTVTDENTGEISEKVKLGTKALAGQWLAYGVTRSVTKRSVMT LAYCSKEFCFRQQVLEDTIQPAIDSCKCLMFTQPNQAACYMAHLIWESVSVTV VAAVFAMNWLKSAAKLLAAFVKDKKTGFILRKRCAVHWVIPDGFPVWQFYKKP IQTRLNLMFLGQFRLQPTINTNKCSEIDAHKQESGIAPNFVHSQDCSHLRKTV VWAHEKYCIESFALIHDSFGTIPADAANLFKAVRETMVDTYESCDVLADFYDQ FALMLHESQLDKMPALPAKGNLNLRDILESDFAFAG | 109 |
| G47A, D351V, G884 | MNTINIAKNDFSDIELAAIFFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKKVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMKYEDVYMPEVYK AINIAQNTAWKINKKVLAVANVITKWKHCPVEVTPAIEREELPMKPEDIDMND EALTAWKRAAAAVYRKDKARKSRRISLEFMLEQANKFANHKAIWFDYNMDWRG RVYAVSMFNPQGNDMTKGLLILAKGKPIGKEGYYWLKIHGANCAGVDKVPFPE RIKFIEENHENIMACAKSPLENTWWAEQDSPFCFLAFCFEYAGVQHHGLSYNC SLPLAFDCSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQFKLQPTINTNKDSEIDAHKQESGIAPNFVHSQDGSHLKKTV VWAHEKYGIESFALIHDSFGTIPADAANLFKAVRETMVDTYESCDVLADFYDQ FADQLHESQLDKMDALPAKCNLNLRDILESDFAFAG | 110 |
| G47A, D351V, K387S, G884 | MNTINIAKNDFSDIELAAIPFNTLADHYGERLAREQLALEHESYEMAEAKFRK MFERQLKAGEVADNAAAKPLITTLLPKMIARINDWFEEVKAKRCKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEVTPAIEREELPMKPEDIDMNP EALTAWKKAAAAVYRSDKARKSRRISLEFMLEQANKFANHKAIWFFYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTDDGFPVWQEYKKD IQTRLNLMFLGQFRLQPTINTNKCSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 111 |
| G47A, D351V, K387N, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPIAFQFL QEIKPEAVAYITIKTTLACLTSADNTTVQAVASAIGRAIEDEARFGRIRDLEA KHYKRNVEEQLNKRVGHVYKKAFMQVVEADMLSRGLLGGEAWSSWHKEPSIHV GVRCIEMLIESTGMVSLHRQNAGVVGQDSETIELAPEYAEAIATRAGALAGIS PMFQPCVVPPKPWTGITGSSGYWANGRRPLALVRTHSKKALMRYEDVYMPEVYK AINIAQNTAWKINKKVLAVANVITKWKHCPVEVTPAIEREELPMKPEDIDMNP EALTAWKRAAAAVYRHDKARKSRRISLEFMLEQANKFANHKAIWFRYNMDWRG RVYAVSMENPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQPAIDSGKGLMFTQPNQAAGYMAHLIWESVSVTV VAAVEAMNWLKSAAKLLAAEVKDKKTGEILRKRCAVHWVIPDGFEWWQEYKKP IQTRLNLMFLGQFRLQPTINTNKDSEIDAHKQESCIAPNEVHSQDGSHLRKTV VWAHEKYGIESFALIHDSFGTIPADAANLFKAVRETMVDIYESCDVLADFYDQ FADQLHESQLDKMPALPAKGNLNLRDILESDFAFAG | 112 |

TABLE 6-continued

Additional Multi-Substitution Variants

| RNA Polymerase Variants | Amino Acid Sequence | SEQ ID NO |
|---|---|---|
| G47A, D351V, K387N, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEVIPAIEREELPMKPEDIDMNP EALTAWKRAAAAVYRNDRARKSRPISLEEMLEQANKFANHKAIWYPYNMDERG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAYDGSCSGIQHFSAMLRDEVGGRAVNLLPSETVQDIYGIVARKVNEILQ ADAINGTDNEVVTVTDENTGEISEKVKLGTKALAGQWLAYGVTRSVTKRSVMT LAYGSKEFGFRQQVLEDTIQPAIDSGKGLMFTQPNQAAGYMAKLIWESVSVTV VAAVEAMNWLKSAAKLLAAEVKDKRIGEILRKRCAVHWVIPDGFPVWQEYKRP IQTRLNLMFLGQFRLQPTINTNKESEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 113 |
| G47A, D351V, E350A, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPIAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVAVIPAIEREELPMKPEDIDMNP EALTAWKRAAAAVYRDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGIDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQYRLQPTINTNKESEIDAHKQESGIAPNYVHSQPGSHLRKTV VWAHEKYGIESFALIHDSEGTIPADAANLFKAVRETMVDTYESCDVLADFYDQ FADQLHESQLDKMPALPAKGNLNLRDILESDFAFAG | 114 |
| G47A, D351V, E350A, K387S, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVAVIPAIEREELPMKPEDIDMNP EALTAWKRAAAAVYRSDKARKSRRISLEFMLEQANKFANHKAIWFPYNMDWRG RVYAVSMFNPQCNDMTKGLLTLAKGKPIGKECYYWLKIHCANCAGVDKVPFPE RIKFIEENHENIMACAKSPLENTWWAEQDSPFCFLAFCFEYAGVQHHGLSYNC SLPLAFDGSGSGIQHFSAMLRDEVGGRAVNLLPSETVQDIYGIVAKKVNEILQ ADAINGIDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDEKTGEILRKRCAVHWVIDDGFPVWQEYKKD IQTRLNLMFLGQFKLQPTINTNKCSEIDAHKQESGIAPNFVHSQDGSHLRKTV VWAHEKYCIESFALIHDSFGTIPADAANLFKAVRETMVDIYESCDVLADFYDQ FADQLHESQLDKMDALPAKGNLNLRDILESDFAFAG | 115 |
| G47A, D351V, E350A, K387N, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGKRPLALVRTHSKKALMRYEDVYMPEVYK AINIAQNTAWKINKKVLAVANVITKWKHCPVAVIPAIEREELPMKPEDIDMND EALTAWKRAAAAVYRHDKARKSRRISLEFMLEQANKFANHKAIWFPYNMDWRG RVYAVSMFNPQCNDMTKGLLTLAKGKPIGKECYYWLKIHCANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYCSKEFCFRQQVLEDTIQPAIDSCKCLMFTQPNQAACYMAHLIWESVSVTV VAAVFAMNWLKSAAKLLAAFVKDKKTGEILRKRCAVHWVIPDGFPVWQFYKKP IQTRLNLMFLGQFRLQPTINTNKCSEIDAHKQESGIAPNFVHSQDCSHLRKTV VWAHEKYCIESFALIHDSFGTIPADAANLFKAVRETMVDTYESCDVLADFYDQ FALMLHESQLDKMPALPAKGNLNLRDILESDFAFAG | 116 |

TABLE 6-continued

Additional Multi-Substitution Variants

| RNA Polymerase Variants | Amino Acid Sequence | SEQ ID NO |
|---|---|---|
| G47A, D351V, E350A, K387N, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTILACLTSADNTTVQAVASAIGRAIEDEAKRGIRDLEA<br>KHFKKNVEEQLNKKVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMKYEDVYMPEVYK<br>AINIAQNTAWKINKKVLAVANVITKWKHCPVAVIPAIEREELPMKPEDIDMND<br>EALTAWKRAAAAVYRNDKARKSRRISLEFMLEQANKFANHKAIWFPYNMDWRC<br>RVYAVSMFNPQGNDMTKGLLILAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYGSKEFGFRQQVLEDTIQPAIDSGKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLGQFKLQPTINTNKDSEIDAHKQESGIAPNFVHSQDGSHLKKTV<br>VWAHEKYGIESFALIHDSFGTIPADAANLFKAVRETMVDTYESCDVLADFYDQ<br>FADQLHESQLDKMDALPAKCNLNLRDILESDFAFAG | 117 |
| G47A, D351V, E350K, G884 | MNTINIAKNDFSDIELAAIPFNTLADHYGERLAREQLALEHESYEMAEAKFKK<br>MFERQLKAGEVADNAAAKPLITTLLPKMIARINDWFEEVKAKRCKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVKVIPAIEREELPMKPEDIDMNP<br>EALTAWKRAAAAVYRKDKARKSRRISLEFMLEQANKFANHKAIWFPYNMDWRC<br>RVYAVSMFNPQGNDMTKGLLTLAKGKPIGKEGYYWLKIHGANCAGVDKVPFPE<br>RIKFIEENHENIMACAKSPLENTAWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKRSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVIDDGFPVWQEYKKD<br>IQTRLNLMFLGQFRLQFTINTNKCSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | 118 |
| G47A, D351V, E350K, K1387S, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>RHYKRNVEEQLNKRVGHVYKKAYMQVVEADMLSRGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVKVIPAIEREELPMKPEDIDMNP<br>EALTAWKRAAAAVYRSDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYGSKEFGFRQQVLEDTIQPAIDSGKGLMFTQPNQAAGYMAHLIWESVSVTV<br>VAAVEAMNWLKSAAKLLAAEVKDKKTGEILRKRCAVHWVIPDGFEWWQEYKKP<br>IQTRLNLMFLGQFRLQPTINTNKDSEIDAHKQESCIAPNFVHSQDGSHLRKTV<br>VWAHEKYGIESFALIHDSFGTIPADAANLFKAVRETMVDIYESCDVLADFYDQ<br>FADQLHESQLDKMPALPAKGNLNLRDILESDFAFAG | 119 |
| G47A, D351V, E350K, K387H, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESIGMVSLHRQNAGVVGQDSETIELAPEYAEAIAIRAGALAGIS<br>PMFQPCVVPPKFWTGITGGGYWANGRRPLALVRTHSKKALMRYEDVYMPEVYK<br>AINIAQNTAWKINKKVLAVANVITKWKHCPVKVIPAIEREELPMKPEDIDMNP<br>EALTAWKRAAAAVYRHDRARKSRRISLEFMLEQANKFANHKAIWYPYNMDERG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHYSAMLRDEVGGRAVNLLPSETVQDIYGIVARKVNEILQ<br>ADAINGTDNEVVTVTDENTGEISEKVKLGTKALAGQWLAYGVTRSVTKRSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVIPDGFPVWQEYKKP<br>IQTRLNLMFLGQFRLQPTINTNKESEIDAHKQESGIAPNFVHSQDGSHLRKTV<br>VWAHEKYGIESFALIHDSFGTIPADAANLFKAVREIMVDTYESCDVLADFYDQ<br>FADQLHESQLDKMPALPAKGNLNLRDILESDFAFAG | 120 |

TABLE 6-continued

Additional Multi-Substitution Variants

| RNA Polymerase Variants | Amino Acid Sequence | SEQ ID NO |
|---|---|---|
| G47A, D351V, E350K, K387N, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPIAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVKVIPAIEREELPMKPEDIDMNP EALTAWKRAAAAVYRNDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQYRLQPTINTNKESEIDAHKQESGIAPNYVHSQDGSHLRKIV VWAHEKYGIESFALIHDSFGTIPADAANLFKAVRETMVDTYESCDVLADFYDQ FADQLHESQLDKMPALPAKGNLNLRDILESDFAFAG | 121 |
| G47A, D351V, E350N, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVNVIPAIEREELPMKPEDIDMNP EALTAWKRAAAAVYRKDKARKSRRISLEFMLEQANKFANHKAIWFPYNMDWRG RVYAVSMFNPQCNDMTKGLLTLAKGKPIGKECYYWLKIHCANCAGVDKVPFPE RIKFIEENHENIMACAKSPLENTWWAEQDSPFCFLAPCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGYKALAGQWLAYSVTRSVLKRSVMT LAYGSKEFGFRQQVLEDTIQPAIDSGKGLMFTQPNQAAGYMAKLIWESVSVTV VAAVEAMNWLKSAAKLLAAEVKDEKTGEILRKRCAVHWVTPDGFPVWQEYKKP IQTRLNLMFLGQFKLQPTINTNKCSEIDAHKQESGIAPNFVHSQDGSHLRKTV VWAHEKYCIESFALIHDSFGTIPADAANLFKAVRETMVDIYESCDVLADFYDQ FADQLHESQLDKMPALPAKGNLNLRDILESDFAFAG | 122 |
| G47A, D351V, E350N, K387S, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGKRPLALVRTHSKKALMRYEDVYMPEVYK AINIAQNTAWKINKKVLAVANVITKWKHCPVNVIPAIEREELPMKPEDIDMND EALTAWKRAAAAVYRSDKARKSRFISLEFMLEQANKFANHKAIWFPYNMDWRG RVYAVSMFNPQCNDMTKGLLTLAKGKPIGKECYYWLKIHCANCAGVDKVPFPE RIKFIEENHENIMACAKSPLENTWWAEQDSPFCFLAFCFEYAGVQHHCLSYNG SLPLAFDGSCSGIQHFSAMLRDEVGGRAVNLLPSETVQDIYGIVAKKVNEILQ ADAINGTDNEVVTVTDENTGEISEKVKLGYKALAGQWLAYGVTRSVLKRSVMT LAYCSKEFCFRQQVLEDTIQPAIDSCKCLMFTQPNQAACYMAHLIWESVSVTV VAAVEAMNWLKSAAKLLAAEVKDKKTGEILRKRCAVHWVTPDGFPVWQEYKKP IQTRLNLMFLGQFRLQPTINTNKCSEIDAHKQESGIAPNFVHSQDCSHLRKTV VWAHEKYCIESFALIHDSFGTIPADAANLFKAVRETMVDTYESCDVLADFYDQ FALMLHESQLDKMPALPAKGNLNLRDILESDFAFAG | 123 |
| G47A, D351V, E350N, K387H, G884 | MNTINIAKNDFSDIELAAIPFNTLADHYGERLAREQLALENESYEMAEARFRK MFERQLKAGEVADNAAAKPLITTLLPKMIARINDWFEEVKAKRGKRPTAFQFL QEIKPEAVAYITIKTILAGLTSADNTTVQAVASAIGRAIEDEAFFGRIRDLEA KHFKKNVEEQLNKKVGHVYKKAFMQVVEADMLSKGLLGGEAWSSWHKEDSIHV GVRCIEMLIESTGMVSLHRQNAGVVGQDSETIELAPEYAEAIATRAGALAGIS PMKQPCVVPPKFWTGITGSGYWANGFRPLALVRTHSKKALMRYEDVYMPEVYK AINIAQNTAWKINKKVLAVANVITKWKHCPVNVIPAIEREELPMKDEDIDMNP EALTAWKRAAAAVYRHDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNG SLPLAPDCSCSCIQHFSAMLRDEVGGRAVNLLPSETVQDIYGIVAKKVNEILQ ADAINGTDNEVVTVTDENTGEISEKVKLGYKALAGQWLAYSVTRSVLKRSVMT LAYGSKEFGFRQQVLEDTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMYLGQYRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 124 |

TABLE 6-continued

Additional Multi-Substitution Variants

| RNA Polymerase Variants | Amino Acid Sequence | SEQ ID NO |
|---|---|---|
| G47A, D351V, E350N, K387N, G884 | MNTINIAKNDFSDIELAAIPFNTLADHYGERLAREQLALEHESYEMAEAKFRK MFERQLKAGEVADNAAAKPLITTLLPKMIARINDWFEEVKAKRCKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVNVIPAIEREELPMKPEDIDMNP EALTAWKKAAAAVYRNDKARKSRRISLEFMLEQANKFANHKAIWFFYNMDWRG RVYAVSMFNPQGNDMTKGLLTLAKGKPIGKEGYYWLKIHGANCAGVDKVPFPE RIKFIEENHENIMACAKSPLENTAMAEQDSPYCYLAYCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGYKALAGQWLAYSVTRSVLKKSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 125 |
| G47A, D351V, E350W, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHYKKNVEEQLNKRVGHVYKKAYMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVWVIPAIEREELPMKPEDIDMNP EALTAWKRAAAAVYRKDKARKSRRTSLEFMLEQANKFANHKAIWFPYNMDWRG RVYAVSMFNPQGNDMTKCLLTLAKGKPIGKEGYYWLKIHGANCAGVDKVPFPE RIKFIEENHENIMACAKSPLENTWWAEQDSPFCFLAFCFEYAGVQHHGLSYNC SLPLAEDGSCSGIQHFSAMLRDEVGGRAVNLLPSETVQDIYGIVAKKVNEILQ ADAINGTDNEVVTVTDENTGEISEKVKLGTKALAGQWLAYGVTRSVPKRSVMT LAYGSKEFGFRQQVLEDTIQPAIDSGKGLMFTQPNQAAGYMAHLIWESVSVTV VAAVEAMNWLKSAAKLLAAEVKDKKTGEILRKRCAVHWVIPDGFPVWQEYKKP IQTRLNLMFLGQFRLQPTINTNKDSEIDAHKQESCIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 126 |
| G47A, D351V, E350W, K387S, G884 | MNTINIAKNDFSDIELAAIPFNTLADHYGERLAREQLALEHESYEMAEARFRK MFERQLKACEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSETIELAPEYAEAIAIRAGALAGIS PMFQPCVVPPKPWTGITGGGYWANGRRPLALVRTHSKKALMRYEDVYMPEVYK AINIAQNTAWKINKKVLAVANVITKWKHCPVWVIPAIEREELPMKPEDIDMNP EALTAWKRAAAAVYRSDKARKSRRISLEFMLEQANKRANHKAIWYPYNMDERG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNG SLPLAFDGSCSGIQHFSAMLRDEVGGRAVNLLPSETVQDIMGIVAKKVNEILQ ADAINGTDNEVVTVTDENTGEISEKVKLGTKALAGQWLAYGVTRSVPHRSVMT LAYGSKEFGFRQQVLEDTIQPAIDSGKGLMFTQPNQAAGYMAKLIWESVSVTV VAAVEAMNWLKSAAKLLAAEVKDKRIGEILRKRCAVHWVIPDGFPVWQEYKKP IQTRLNLMFLGQFRLQPTINTNKESEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 127 |
| G47A, D351V, E350W, K387H, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPIAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVWVIPAIEREELPMKPEDIDMNP EALTAWKRAAAAVYRHDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNG SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVPKRSVMT LAYGSKEFGFRQQVLEDTIQPAIDSGKGLMFTQPNQAAGYMAKLIWESVSVTV | 128 |

TABLE 6-continued

Additional Multi-Substitution Variants

| RNA Polymerase Variants | Amino Acid Sequence | SEQ ID NO |
|---|---|---|
| | VAAVEAMNWLKSAAKLLAAEVKDKKTGEILRKRCAVHWVTPDGFPVWQEYKKP IQTRLNLMFLGQYRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | |
| G47A, D351V, E350W, K387N, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVWVIPAIEREELPMKPEDIDMNP EALTAWKRAAAAVYRNDKARKSRRLSLEFMLEQANKFANHKAIWFDYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEDTIQPAIESGKCLMFTQPNQAAGYMAKLIWESVSVTV VAAVEAMNWLKSAAKLLAAEVKDEKTGEILRKRCAVHWVTPDGFPVWQEYKKP IQTRLNLMFLGQFPLQPTINTNKESEIDAHKQESGIAPNFVHSQDGSHLRKTV VWAHEKYCIESFALIHDSFGTIPADAANLFKAVRETMVDIYESCDVLADFYDQ FADQLHESQLDKMPALFAKGNLNLRDILESDFAFAG | 129 |
| G47A, D653A, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKFEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMND EALTAWKRAAAAVYKKDKARKSRRISLEFMEEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEATIQPAIDSGKGLMFTQPNQAAGYMAKLIWESVSVTV VAAVEAMNWLKSAAKLLAAEVKDKKTGEILRKRCAVHWVTPDGFEWWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDEAFAG | 130 |
| G47A, D653F, G884 | MNTINIAKNDFSDIELAAIPFNTLADHYGERLAREQLALEHESYEMAAEARFRK MFERQLKAGEVADNAAAKPLITTLLPKMIARINDWFEEVKAKRGKRPTAFQFL QEIKFEAVAYITIKTILACLTSADNTTVQAVASAIGRAIEDEAKYGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS FMPQPCVVPPKPWTGITGGGYWANGRRPLAEVRTHSKKALMKYEDVYMPEVYK AINIAQNTAWKINKKVLAVANVITKWKHCPVEDIPAIEREELPMKPEDIDMNP EALTAWKRAAAAVYRKDKARKSRPLSLEFMLEQANKFANHKAIWFDYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLFLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEFTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMDALPAKCNLNLRDILESDFAFAG | 131 |
| G47A, D653G, G884 | MNTINIAKNDFSDIELAALPFNTLADHYGERLAREQLALEHESYEMAEAKFRK MFERQLKAGEVADNAAAKPLITTLLPKMIARINDWFEEVKAKRCKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRLSLEFMLEQANKFANHKAIWFFYNMDWRG RVYAVSMFNPQGNDMTKGLLTLAKGKPIGKEGYYWLKIHGANCAGVDKVPFFE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEGTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKCSEIDAHKQESGIAPNFVHSQDGSHLRKTV | 132 |

TABLE 6-continued

Additional Multi-Substitution Variants

| RNA Polymerase Variants | Amino Acid Sequence | SEQ ID NO |
|---|---|---|
| | VWAHEKYGIESFALIHDSFGTIPADAANLFKAVRETMVDTYESCDVLADFYDQ FADQLHESQLDKMPALPAKGNLNLRDILESDFAFAG | |
| G47A, D653K G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHYKRNVEEQLNKRVGHVYKKAYMQVVEADMLSRGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFRYNMDWRG RVYAVSMENPQGNDMIKGLLTLAKGKPIGKEGYYWLKIHGANCAGVDKVPFPE RIKFTEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGGKALAGQWLAYGVTRSVGKRSVMI LAYGSKEFGFRQQVLEHTIQPAIDSGKGLMFTQPNQAAGYMAHLIWESVSVTV VAAVEAMNWLKSAAKLLAAEVKDKKTGEILRKRCAVHWVIPDGFEWWQEYKKP IQTRLNLMFLGQFRLQPTINTNKDSEIDAHKQESCIAPNEVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 133 |
| G47A, D653I, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSETIELAPEYAEAIAIRAGALAGIS PMFQPCVVPPKFWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVARKVNEILQ ADAINGTDNEVVTVTDENTGEISEKVKLGGKALAGQWLAYGVTRSVGKRSVMT LAYGSKEFGFRQQVLEITIQPAICSGKGLMFTQPNQAAGYMAHLIWESVSVIV VAAVEAMNWLKSAAKLLAAEVKDKKTGEILRKRCAVHWVIPDGFPVWQEYKKP IQTRLNLMFLGQPRLQPTINTNKESEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 134 |
| G47A, D653L, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLELTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQYRLQPTINTNKESEIDAHKQESGIAPNYVHSQDGSHLRKTV VWAHEKYGIESFALIHDSEGTIPADAANLFKAVRETMVDTYESCDVLADFYDQ FADQLHESQLDKMPALPAKGNLNLRDILESDFAFAG | 135 |
| G47A, D653M, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLISADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRPTSLEFMLEQANKFANHKAIWFPYNMDWRG RVYAVSMFNPQGNDMTKGLLTLAKGKPIGKEGYYWLKIHGANCAGVDKVPFPE RIKFIEENHENIMAGAKSPLENTWWAEQDSPFCFLAPCFEYACVQHHCLSYNC SLPLAFDGSCSGIQHFSAMLRDEVGGRAVNLLPSETVQDIYGIVAKKVNEILQ ADAINGTDNEVVTVTDENTGEISEKVKLGYKALAGQWLAYSVTRSVCKRSVMT LAYCSKEFCFRQQVLEMTIQPAIESCKCLMFTQPNQAACYMAKLIWESVSVTV VAAVEAMNWLKSAAKLLAAEVKDEKTGEILRKRCAVHWVTPDGFPVWQEYKKP IQTRLNLMFLGQFRLQPTINTNKESEIDAHKQESGIAPNFVHSQDCSHLRKTV VWAHEKYCIESFALIHDSFCTIPADAANLFKAVRETMVDIYESCDVLADFYDQ FADQLHESQLDKMPALPAKGNLNLRDILESDFAFAG | 136 |

TABLE 6-continued

Additional Multi-Substitution Variants

| RNA Polymerase Variants | Amino Acid Sequence | SEQ ID NO |
|---|---|---|
| G47A, D653N, G884 | MNTINIAKNDFSDIELAAIPFNTLADHYGERLAREQLALEHEGYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIKV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELGMKPEDIDMND<br>EALTAWKRAAAAVYRKDKARKSRRISLEFMEEQANKKANHKAIWYPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGYKALAGQWLAYGVTRSVYKRSVMT<br>LAYGSKEFGFRQQVLENTIQPAIDSGKGLMFTQPNQAAGYMAKLIWESVSVTV<br>VAAVEAMNWLKSAAKLLAAEVKDKKTGEILRKRCAVHWYTKDGEKVWQEYKKK<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADGLHESQLDKMPALKAKGNLNLRDILESDEAFAG | 137 |
| G47A, D653P, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARYGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMPQPCVVPPKPWTGITGSGYWANGPRPLAEVRTHSKKALMRYEDVYMPEVYK<br>AINIAQNTAWKINKKVLAVANVITKWKHCPVEDIPAIEREELPMKKEDIDMNP<br>EALTAWKRAAAAVYRKDKARKSRRISLEFMLEQANKFANHKAIWFDYNMDWRG<br>RVYAVSMFNPQGNDMIKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKRSVMT<br>LAYGSKEFGFRQQVLEPTIQPAIDSGKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMYLGQPRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMDALPAKCNLNLRDILESDFAFAG | 138 |
| G47A, D653Q, G884 | MNTINIAKNDKSDLELAALPFNTLAPHYGERLAREQLALEHESYEMAEARKRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVCHVYKKAFMQVVEADMLSKGLLGCEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFKYNMDWRG<br>RVYAVSMFNPQGNDMIKGLLTLAKGKPIGKEGYYWLKIHGANCAGVDKVPFPE<br>RIKFIEENHENIMACAKSPLENTWWAEQDSPYCYLAYCYEYACVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGYKALAGQWLAYSVTRSVCHRSVMT<br>LAYCSKEFGFRQQVLEQTIQPAIESCKCLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKCSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | 139 |
| G47A, D653R, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHYKRNVEEQLNKRVGHVYKKAFMQVVEADMLSRGLLGGEAWSSWHKEPSIHV<br>GVRCIEMLIESTGMVSLHRQNAGVVGQDSETIELAPEYAEAIATRAGALAGIS<br>PMFQPCVVPPKPWTGITGGGYWANGPRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWETYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYGSKEFGFRQQVLERTIQPAIDSGKGLMFTQPNQAAGYMAHLIWESVSVTV | 140 |

TABLE 6-continued

Additional Multi-Substitution Variants

| RNA Polymerase Variants | Amino Acid Sequence | SEQ ID NO |
|---|---|---|
| | VAAVEAMNWLKSAAKLLAAEVKDKKTGEILRKRCAVHWVIPDGFEWWQEYKKP IQTRLNLMFLGQFRLQPTINTNKDSEIDAHKQESCIAPNFVHSQDGSHLRKTV VWAHEKYGIESFALIHDSFGTIPADAANLFKAVRETMVDIYESCDVLADFYDQ FADQLHESQLDKMPALPAKGNLNLRDILESDFAFAG | |
| G47A, D653S, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSETIELAPEYAEAIAIRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAYDGSCSGIQHFSAMLRDEVGGRAVNLLPSETVQDIYGIVARKVNEILQ ADAINGTDNEVVTVTDENTGEISEKVKLGTKALAGQWLAYGVTRSVTKRSVMT LAYGSKEFGFRQQVLESTIQPAIDSGKGLMFTQPNQAAGYMAHLIWESVSVTV VAAVEAMNELKSAAKELAAEVKDKRIGEILRKRCAVHWVIPEGFPVWQEYKKP IQTRLNLMFLGQFRLQPTINTNKESEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 141 |
| G47A, D653V, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQPSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEVTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQYRLQPTINTNKESEIDAHKQESGIAPNYVHSQPGSHLRKTV VWAHEKYGIESFALIHDSFGTIPADAANLFKAVREIMVDTYESCDVLADFYDQ FADQLHESQLDKMPALPAKGNLNLRDILESDFAFAG | 142 |
| G47A, D653Y, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRLSLEFMLEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEYTIQPAIDSGKGLMFTQPNQAAGYMAKLIWESVSVTV VAAVEAMNWLKSAAKLLAAEVKDEKTGEILRKRCAVHWVTPDGFPVWQEYKKP IQTRLNLMFLGQFPLQPTINTNKDSEIDAHKQESGIAPNFVHSQDGSHLRKTV VWAHEKYCGESFALIHDSFGTIPADAANLFKAVRETMVDIYESCDVLADFYDQ FADQLHESQLDKMPALPAFKGNLNLRDILESDFAFAG | 143 |
| G47A, P657W, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKFEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDTPAIEREELPMKPEDIDMND EALTAWKRAAAAVYKKDKARKSRRISLEFMEEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQWAIDSGKGLMFTQPNQAAGYMAKLIWESVSVTV VAAVEAMNWLKSAAKLLAAEVKDKKTGEILRKRCAVHWVTPDGFEWWQEYKKP IQTRLNLMFLGQFRLQPTINTNKDSEIDAHKQESGIAPNFVHSQDGSHLRKTV | 144 |

TABLE 6-continued

Additional Multi-Substitution Variants

| RNA Polymerase Variants | Amino Acid Sequence | SEQ ID NO |
|---|---|---|
| | VWAHEKYGIESFALIHDSFGTIPADAANLFKAVRETMVDTYESCDVLADFYDQ FAIMLHESQLDKMPALPAKGNLNLRDILESDFAFAG | |
| G47A, P657R, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEAKYGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS FMPQPCVVPFKFWTGITGGGYWANGRRPLAEVRTHSKKALMKYEDVYMPEVYK AINIAQNTAWKINKKVLAVANVITKWKHCPVEDIPAIEREELPMKPEDIDMNP EALTAWKRAAAAVYRKDKARKSRPLSLEFMLEQANKFANHKAIWFDYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLFLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQRAIDSGKGLMFTQPNOAAGYMAHLIWESVSVTV VAAVEAMNWLKSAAKLLAAEVKDKKTGEILRKRCAVHWVTPDGFPVWQEYKKP IQTRLNLMFLGQFKLQPTINTNKDSEIDAHKQESGIAPNFVHSQDGSHLKKTV VWAHEKYGIESFALIHDSFGTIPADAANLFKAVRETMVDTYESCDVLADFYDQ FADQLHESQLDKMDALPAKGNLNLRDILESDFAFAG | 145 |
| G47A, P657A, G884 | MNTINIAKNDFSDIELAAIPFNTLADHYGERLAREQLALEHESYEMAEAKFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPALEREELPMKPEDIDMNP EALTAWKRAAAAVYRKDKARKSRRISLEFMLEQANKFANHKAIWFFYNMDWRG RVYAVSMFNPQGNDMTKGLLTLAKGKPIGKEGYYWLKIHGANCAGVDKVPFFE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEDTIQAAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 146 |
| G47A, D653W, P657W, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPIAFQFL QEIKPEAVAYITIKTTLACLTSADNTTVQAVASAIGRAIEDEARFGRIRDLEA KHFKKNVEEQLNKRVGHVYKKAYMQVVEADMLSKCLLCGEAWSSWHKEDSTHV GVRCIEMLIESTGMVSLHRQNAGVVGQDSETIELAPEYAEAIATRAGALAGIS PMFQPCVVPPKPWTGITGGGYWANGPRPLALVRTHSKKALMRYEDVYMPEVYK AINIAQNTAWKINKKVLAVANVITKWKHGRVEDTPATEREELPMKREDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFTEENHENIMACAKSPLENTWWAEQPSPFCFLAFCFEYAGVQHHGLSYNC SLPLAEDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEWTTQWAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESCIAPNFVHSQDGSHLRKTV VWAHEKYGIESFALIHDSFGTIPADAANLFKAVRETMVDIYESCDVLADFYDQ FADQLHESQLDKMPALPAKGNLNLRDILESDFAFAG | 147 |
| G47A, D653W, P657R, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSEITELAPEYAEATAIRAGAGTS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGTQHYSAMLRDEVGGRAVNLLPSETVQDIYGIVAKKVNETLQ ADAINGTDNEVVTVTDENTGEISEKVKLGTKALAGQWLAYGVTRSVTKRSVMT LAYGSKEFGFRQQVLEWTIQRATDSGKGLMFTQPNQAAGYMAHLTWESVSVTV VAAVEAMNWLKSAAKLLAAEVKDKKTGEILRKRCAVHWIPDGFPVWQEYKKP IQTRLNLMFLGQFRLQPTININKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 148 |

TABLE 6-continued

Additional Multi-Substitution Variants

| RNA Polymerase Variants | Amino Acid Sequence | SEQ ID NO |
|---|---|---|
| G47A, D653W, P657A, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDTPAIEREELPMKPEDIDMNP<br>EALTAWKRAAAAVYRKDKARKSRRISLEFMLEQANKFANHKAIWFRYNMDWRG<br>RVYAVSMFNPQGNDMTKGLLTLAKGKPIGKEGYYWLKIHGANCAGVDKVPFPE<br>RIKFIEENHENIMACAKSPLENTWWAEQPSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKRSVMT<br>LAYGSKEFGFRQQVLEWTIQAAIDSGKGLMFTQPNQAAGYMAHLIWESVSVTV<br>VAAVEAMNWLKSAAKLLAAEVKDKKTGEILRKRCAVHWVTPDGFPVWQEYKKP<br>TQTRLNLMFLGQYRLQPTINTNKESETDAHKQESGIAPNYVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | 149 |
| G47A, D653T, P657W, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWERYNMDWRG<br>RVYAVSMENPQCNDMTKGLLTLAKGKPIGKECYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKRSVMT<br>LAYGSKEFGFRQQVLETTIQWAIDSGKGLMFTQPNQAAGYMAKLIWESVSVTV<br>VAAVEAMNWLKSAAKLLAAEVKDEKTGEILRKRCAVHWVTDDGFPVWQEYKKD<br>IQTRLNLMFLGQFRLQPTINTNKDSEIDAHKQESGIAPNFVHSQDCSHLRKTV<br>VWAHEKYGIESFALIHDSFCTIPADAANLFKAVRETMVDTYESCDVLADFYDQ<br>FADQLHESQLDKMDALPAKGNLNLRDILESDFAFAG | 150 |
| G47A, D653T, P657R, G884 | MNTINIAKNDFSDIELAAIPFNTLADHYCERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWIGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWYRYNMDWRG<br>RVYAVSMENPQGNDMTKGLLTLAKGKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYGSKEFGFRQQVLETTIQRAIDSGKGLMFTQPNQAAGYMAKLIWESVSVTV<br>VAAVEAMNWLKSAAKLLAAEVKDKKTGEILRKRCAVHWVTPDGFEWWQEYKKP<br>IQTRLNLMFLGQFRLQPTINTNKDSEIDAHKQESGIAPNEVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | 151 |
| G47A, D653T, P657A, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRALEDEAREGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPRKPWTGITGGGYWANGRRPLALVRTHSKKALMRYEDVYMPEVYK<br>AINIAQNTAWKINKKVLAVANVITKWKHCPVEDIPAIEREELPMKREDIDMND<br>EALTAWKRAAAAVYRKDKARKSRRISLEFMLEQANKFANHKAIWFDYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT | 152 |

TABLE 6-continued

Additional Multi-Substitution Variants

| RNA Polymerase Variants | Amino Acid Sequence | SEQ ID NO |
|---|---|---|
| | LAYGSKEFGFRQQVLETTIQAAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMYLGQYKLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKCNLNLRDILESDFAFAG | |
| G47A, D653K, P657W, G884 | MNTINIAKNDFSDLELAAIPFNTLADHYGERLAREQLALEHESYEMAEARFKK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPALEREELPMKPEDIDMNP EALTAWKRAAAAVYRKDKARKSRRISLEFMLEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTAMAEQDSPECELAYCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEKTIQWAIDSGKGLMFTQPNQAAGYMAKLIWESVSVTV VAAVEAMNWLKSAAKLLAAEVKDKKTGEILRKRCAVHWVTDDGFPVWQEYKKD IQTRLNLMFLGQFRLQPTINTNKDSEIDAHKQESGIAPNEVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 153 |
| G47A, D653K, P657R, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHYKKNVEEQLNKRVGHVYKKAYMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEKTIQRAIDSGKGLMFTQPNQAAGYMAHLIWESVSVTV VAAVEAMNWLKSAAKLLAAEVKDKKTGEILRKRCAVHWVIPDGFEWWQEYKKP IQTRLNLMFLGQFRLQPTINTNKDSEIDAHKQESCIAPNFVHSQDGSHLRKTV VWAHEKYGIESFALIHDSFGTIPADAANLFKAVRETMVDIYESCDVLADFYDQ FADQLHESQLDKMPALPAKGNLNLRDILESDFAFAG | 154 |
| G47A, D653K, P657A, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSETIELAPEYAEAIAIRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHYSAMLRDEVGGRAVNLLPSETVQDIYGIVARKVNEILQ ADAINGTDNEVVTVTDENTGEISEKVKLGTKALAGQWLAYGVTRSVTKRSVMT LAYGSKEFGFRQQVLEKTIQAAIDSGKGLMFTQPNQAAGYMAHLIWESVSVTV VAAVEAMNELKSAAKLLAAEVKDKKIGEILRKRCAVHWVTPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 155 |
| G47A, N437T, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFRYNMDWRG RVYAVSMFNPQGTDMTKGLLILAKGKRIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP | 156 |

TABLE 6-continued

Additional Multi-Substitution Variants

| RNA Polymerase Variants | Amino Acid Sequence | SEQ ID NO |
|---|---|---|
| | IQTRLNLMFLGQYRLQPTINTNKESEIDAHKQESGIAPNYVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | |
| G47A, N437Y, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMENPQCYDMTKGLLTLAKCKPIGKEGYYWLKIHGANCAGVDKVPFPE RIKFIEENHENIMACAKSPLENTWWAEQDSPFCFLAFCFEYAGVQHHCLSYNC SLPLAFDQSCSGIQHFSAMLRDEVGGRAVNLLPSETVQDIYGIVAKKVNEILQ ADAINGTDNEVVTVTDENTGEISEKVKLGYKALACQWLAYSVTRSVYKRSVMT LAYCSKEFGFRQQVLEDTIQPAIDSCKCLMFTQPNQAAGYMAKLIWESVSVTV VAAVEAMNWLKSAAKLLAAEVKDEKTGEILRKRCAVHWVTEDGFPVWQEYKKE IQTRLNLMFLGQFRLQPTINTNKDSEIDAHKQESGIAPNFVHSQDCSHLRKTV VWAHEKYCIESFALIHDSFGTIPADAANLFKAVRETMVDIYESCDVLADFYDQ FADQLHESQLDKMFALPAKGNLNLRDILESDFAFAG | 157 |
| G47A, N437I, G884 | MNTINIAKNDFSDIELAAIPFNTLAQHYCERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVCHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAWNFRYNMDWRG RVYAVSMENPQGIDMTKGLLTLAKGKPIGKEGYYWLKIHGANCAGVDKVPFPE RIKFIEENHENIMACAKSPLENTWWAEQCSPFCFLAFCFEYACVQHHCLSYNC SLPLAFDGSCSGIQHFSAMLRDEVGGRAVNLLPSETVQDIYGIVAKKVNEILQ ADAINGTDNEVVTVTDENTGEISEKVKLCYKALAGQWLAYGVTRSVLKRSVMT LAYCSKEFCFRQQVLEDTIQPAIDSCKCLMFTQPNQAACYMAHLIWESVSVTV VAAVEAMNWLKSAAKLLAAEVKDKKTGEILRKRCAVHWVTPDGFEWWQEYKKP IQTRLNLMFLGQFRLQPTINTNKDSEIDAHKQESGIAPNEVHSQDGSHLRKTV VWAHEKYGIESFALIHDSFGTIPADAANLFKAVRETMVDTYESCDVLADFYDQ FAIMLHESQLDKMPALPAKGNLNLRDILESDFAFAG | 158 |
| G47A, N437F, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTYVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMFNPQGFDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSCIQHFSAMLRDEVCGRAVNLLPSEIVQDIYGIVAKKVNEILQ ADAINGTDNEVVTVTDENTGEISEKVKLGTKALAGQWLAYGVTRSVTKRSVMT LAYGSKFFGFRQQVLEDTIQPAIDSGKGLMFTQPNQAAGYMAHLIWESVSVTV VAAVEAMNWLKSAAKLLAAEVKDKKTCEILRKRCAVHWVTPDGFPVWQEYKKP IQTRLNLMYLGQYRLQRTINYNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKCNLNLRDILESDFAFAG | 159 |
| G47A, K441R, G884 | MNTINIAKNDFSDIELAAIPFNTLADHYGEKLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVCHVYKKAFMQVVEADMLSKGLLGGEAWSSWHKEDSIHV GVRCIEMLIESTGMVSLHRQNACVVCQDSETIELAPEYAEAIATRACALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMENPQCNDMTRGLLTLAKGKPIGKEGYYWLKIHCANCAGVDKVPFPE RIKFIEENHENIMACAKSPLENTWWAEQDSPFCFLAFCFEYAGVQHHGLSYNC SLPLAFDGSCSGIQHFSAMLRDEVCGRAVNLLPSETVQDIYGIVAKKVNEILQ | 160 |

TABLE 6-continued

Additional Multi-Substitution Variants

| RNA Polymerase Variants | Amino Acid Sequence | SEQ ID NO |
|---|---|---|
| | ADAINGTDNEVVTVTDENTGEISEKVKLCYKALAGQWLAYSVTRSVYKRSVMT<br>LAYGSKEYGFRQQVLEDTIQPAIDSGKGLMFTQPNQAACYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKDSEIDAHKQESGIAPNEVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | |
| G47A, K441R, N437T, G884 | MNTINIAKNDFSDIELAAIPFNTLADHYGERLAREQLALEHESYEMAEARFRK<br>MFERQLKAGEVADNAAAKPLITTLLFKMIARINDWFEEVKAKRGKRFTAFQFL<br>QEIKPEAVAYITIKTTLACLTSADNTTVQAVASAIGRAIEDEARFGRIRDLEA<br>KHYKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSSGYWANGPRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFRYNMDWRG<br>RVYAVSMFNPQCTDMTRGLLTLAKGKPIGKEGYYWLKIHGANCAGVDKVPFPE<br>RIKFIEENHENIMACAKSPLENTWWAEQPSPFCFLAFCFEYAGVQHHGLSYNC<br>SLPLAFDGSCSGIQHFSAMLRDEVGGRAVNLLPSEIVQDIYGIVAKKVNEILQ<br>ADAINGTDNEVVTVTDENTGEISEKVKLCYKALAGQWLAYGVTRSCTKRSVMT<br>LAYGSKEFGFRQQVLEDTIQPAIDSGKGLMFTQPNQAAGYMAHLIWESVSVTV<br>VAAVEAMNWLKSAAKLLAAEVKDKKTGEILRKRCAVHWVIPDGFEWWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDIYESCDVLADFYDQ<br>FADQLHESQLDKMPALPAKGNLNLRDILESDFAFAG | 161 |
| G47A, K441R, N437Y, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRFTAFQFL<br>QEIKPEAVAYITIKTTLACLTSADNTTVQAVASAICRAIEDEARFGRIRDLEA<br>KHFKKNVEEQLNKRVGHVYKKAFMQVVEADMLSKGLLGGEAWSSWHKEDSIHV<br>GVRCIEMLIESIGMVSLHRQNAGVVGQDSETIELAPEYAEAIAIRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRC<br>RVYAVSMFNPQGYDMTRGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAYDGSCSGIQHFSAMLRDEVGGRAVNLLPSETVQDIYGIVARKVNEILQ<br>ADAINGTDNEVVTVTDENTGEISEKVKLGTKALAGQWLAYGVTRSVTKRSVMT<br>LAYGSKEFGFRQQVLEDTIQPAIDSGKGLMFTQPNQAAGYMAKLIWESVSVTV<br>VAAVEAMNWLKSAAKLLAAEVKDKKIGEILRKRCAVHWVIPDGFPVWQEYKKP<br>IQTRLNLMFLGQFRLQPTINTNKESEIDAHKQESGIAPNFVHSQDGSHLRKTV<br>VWAHEKYGIESFALIHDSFGTIPADAANLFKAVREIMVDTYESCDVLADFYDQ<br>FADQLHESQLDKMPALPAKGNLNLRDILESDFAFAG | 162 |
| G47A, K441R, N437I, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRFTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRDISLEFMLDQANKFANHKAIWFDYNMDWRG<br>RVYAVSMFNPQGIDMTRGLLILAKGKRIGNEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKRSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQYRLQPTINTNKDSEIDAHKQESGIAPNYVHSQDGSHLRKIV<br>VWAHEKYGIESFALIHDSEGTIPADAANLFKAVRETMVDTYESCDVLADFYDQ<br>FADQLHESQLDKMPALPAKGNLNLRDILESDFAFAG | 163 |
| G47A, K441R, N437F, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRFTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFDYNMDWRG<br>RVYAVSMENPQCFDMTRGLLTLAKGKPIGKEGYYWLKIHGANCAGVDKVPFPE<br>RIKFIEENHENIMACAKSPLENTWWAEQPSPFCFLAFCFEYAGVQHHCLSYNC<br>SLPLAFDGSCSGIQHFSAMLRDEVGGRAVNLLPSEIVQDIYGIVAKKVNEILQ<br>ADAINGTDNEVVTVTDENTGEISEKVKLGTKALACQWLAYSVTRSVTKRSVMT<br>LAYGSKEFGFRQQVLEDTIQPAIDSCKCLMFTQPNQAAGYMAKLIWESVSVTV | 164 |

TABLE 6-continued

Additional Multi-Substitution Variants

| RNA Polymerase Variants | Amino Acid Sequence | SEQ ID NO |
|---|---|---|
| | VAAVEAMNWLKSAAKLLAAEVKDEKTGEILRKRCAVHWVTDDGFPVWQEYKKD<br>IQTRLNLMFLGQFRLQPTINTNKDSEIDAHKQESCIAPNFVHSQDCSHLRKTV<br>VWAHEKYGIESFALIHDSFCTIPADAANLFKAVRETMVDIYESCDVLADFYDQ<br>FADQLHESQLDKMPALPAKGNLNLRDILESDFAFAG | |
| G47A, S628W, G884 | MNTINIAKNDFSDIELAAIPFNTLADHYCERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVCHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKKAAAAVYRKDKARKSRRISLEFMLEQANKFANHKAIWFRYNMDWRG<br>RVYAVSMENPQGNDMTKGLLTLAKGKPIGKEGYYWLKIHGANCAGVDKVPFPE<br>RIKFIEENHENIMACAKSPLENTWWAEQPSPFCFLAFCFEYACVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRWVTKRSVMT<br>LAYGSKEFGFRQQVLEDTIQPAIDSCKCLMFTQPNQAACYMAHLIWESVSVTV<br>VAAVEAMNWLKSAAKLLAAFVKDKKTGFILRKKCAVHWVTPDGFPVWQEYKKP<br>IQTRLNLMFLGQFRLQPTINTNKDSEIDAHKQESGIAPNEVHSQDGSHLRKTV<br>VWAHEKYGIESFALIHDSFGTIPADAANLFKAVREIMVDTYESCDVLADFYDQ<br>FADCLHESCLDKMPALPAKGNLNLRDILESDFAFAG | 165 |
| G47A, D506W, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARYGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLAEVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQWSPFCFLAFCFEYAGVQHHQLSYNC<br>SLPLAFDGSCSGIQHFSAMLRDEVCGRAVNLLPSETVQDIYGIVAKKVNEILQ<br>ADAINGTDNEVVTVTDENTGEISEKVKLGTKALAGQWLAYGVTRSVTKRSVMT<br>LAYGSKFFGFRQQVLEDTIQPAIDSGKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMYLGQYRLQPTINTNKDSEIDAHKQESGIAPNFVHSQDGSHLKKTV<br>VWAHEKYGIESFALIHDSFGTIPADAANLFKAVRETMVDTYESCDVLADFYDQ<br>FADQLHESQLDKMPALPAKGNLNLRDILESDFAFAG | 166 |
| G47A, D506W, S628W, G884 | MNTINIAKNDFSDIELAAIPFNTLADHYGERLAREQLALEHESYEMAEAKFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVCHVYKKAFMQVVEADMLSKGLLGGEAWSSWHKEDSIHV<br>GVRCIEMLIESTGMVSLHRQNACVVCQDSETIELAPEYAEAIATRACALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRG<br>RVYAVSMENPQGNDMTKGLLTLAKGKPIGKEGYYWLKIHGANCAGVDKVPFFE<br>RIKFIEENHENIMACAKSPLENTWWAEQWSPFCFLAFCFEYACVQHHGLSYNC<br>SLPLAFDGSCSGIQHFSAMLRDEVCGRAVNLLPSEYVQDIYGIVAKKVNEILQ<br>ADAINGTDNEVVTVTDENTGEISEKVKLGTKALAGQWLAYCVTRWVTKRSVMT<br>LAYGSKEFGFRQQVLEDTIQPAIDSGKGLMFTQPNQAACYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKDSEIDAHKQESGIAPNEVHSQDGSHLRKTV<br>VWAHEKYGIESFALIHDSFGTIPADAANLFKAVREIMVDTYESCDVLADFYDQ<br>FADQLHESQLDKMPALPAKGNLNLRDILESDFAFAG | 167 |
| G47A, D506F G884 | MNTINIAKNDFSDIELAAIPFNTLADHYGERLAREQLALEHESYEMAEARFRK<br>MFERQLKAGEVADNAAAKPLITTLLPKMIARINDWEEEVKAKRGKRPTAFQFL<br>QEIKPEAVAYITIKTTLACLTSADNTTVQAVASAIGRAIEDEARFGRIRDLEA<br>KHYKKNVEEQLNKRVGHVYKKAFMQVVEADMLSRGLLGGEAWSSWHKEDSIHV<br>GVRCIEMLIESTGMVSLHRQNAGVVGQDSETIELAPEYAEAIATRAGALAGIS<br>PMFQPCVVPKKPWTGITGGGYWANGRRPLALVRTHSKKALMRYEDVYMPEVYK<br>AINIAQNTAWKINKKVLAVANVITKWKHGPVEDIPAIEREELPMKPEDIDMNP<br>EALTAWKRAAAAVYRKDKARKSRRISLEFMLEQANKFANHKAIWFRYNMDWRG<br>RVYAVSMENPQGNDMIKGLLTLAKGKPIGKEGYYWLKIHGANCAGVDKVPFPE<br>RIKFIEENHENIMACAKSPLENTWWAEQFSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYGSKEFGFRQQVLEDTIQPAIDSGKGLMFTQPNQAAGYMAHLIWESVSVTV<br>VAAVEAMNWLKSAAKLLAAEVKDKKTGEILRKRCAVHWVIPDGFEWWQEYKKP<br>IQTRLNLMFLGQFRLQPTINTNKDSEIDAHKQESGIAPNEVHSQDGSHLRKTV | 168 |

TABLE 6-continued

Additional Multi-Substitution Variants

| RNA Polymerase Variants | Amino Acid Sequence | SEQ ID NO |
|---|---|---|
| | VWAHEKYGIESFALIHDSFGTIPADAANLFKAVRETMVDIYESCDVLADFYDQ FADQLHESQLDKMPALPAKGNLNLRDILESDFAFAG | |
| G47A, D506E S628W, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSETIELAPEYAEAIAIRAGALAGIS PMFQPCVVPPKEMTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRC RVYAVSMFNPQGNDMIKGLLTLAKGKPIGKEGYYWLKIHGANCAGVDKVPFPE RIKFIEENHENIMACAKSPLENTWWAEQFSPFCFLAFCFEYAGVQHHGLSYNC SLPLAYDGSCSGIQHFSAMLRDEVGGRAVNLLPSEIVQDIYGIVARKVNEILQ ADAINGTDNEVVTVTDENTGEISEKVKLGTKALAGQWLAYGVTRWVKTRSVMT LAYGSKEFGFRQQVLEDTIQPAIDSGKGLMFTQPNQAAGYMAKLIWESVSVTV VAAVEAMNWLKSAAKLLAAEVKDKRIGEILRKRGAVHWVIPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 169 |
| G47A, D506Y, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRDISLEFMLEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQYSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQYRLQPTINTNKDSEIDAHKQESGIAPNYVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 170 |
| G47A, D506Y, S628W, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWERYNMDWRG RVYAVSMENPQGNDMTKGLLTLAKGKPIGKEGYYWLKIHGANCAGVDKVPFPE RIKFIEENHENIMACAKSPLENTWWAEQYSPFCFLAFCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGTKALACQWLAYSVTRWVTKRSVMT LAYCSKEFGFRQQVLEDTIQPAIDSCKCLMFTQPNQAAGYMAKLIWESVSVTV VAAVEAMNWLKSAAKLLAAEVKDKEKTGEILRKRCAVHWVTDDGFPVWQEYKKD IQTRLNLMFLGQFRLQPTINTNKDSEIDAHKQESGIAPNFVHSQDCSHLRKTV VWAHEKYGIESFALIHDSFGTIPADAANLFKAVRETMVDIYESCDVLADFYDQ FADQLHESQLDKMPALPAKGNLNLRDILESDFAFAG | 171 |
| G47A, D506R, G884 | MNTINIAKNDFSDIELAAIPFNTLADHYCERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGGGYWANGRRPLALVRTHSKKALMRYEDVYMPEVYK AINIAQNTAWKINKKVLAVANVITKWKHCPVEDIPAIEREELPMKPEDIDMNP EALTAWKKAAAAVYRKDKARKSRRISLEFMLEQANKFANHKATWFPYNMDWRG RVYAVSMENPQGNDMTKGLLTLAKGKPIGKEGYYWLKIHGANCAGVDKVPFPE RIKFIEENHENIMACAKSPLENTWWAEQRSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYCSKEFCFRQQVLEDTIQPAIDSCKCLMFTQPNQAACYMAHLIWESVSVTV VAAVEAMNWLKSAAKLLAAFVKDKKTGFILRKRCAVHWVTPDGFPVWQEYKKP IQTRLNLMFLGQFRLQPTINTNKDSEIDAHKQESGIAPNEVHSQDGSHLRKTV VWAHEKYGIESFALIHDSFGTIPADAANLFKAVRETMVDTYESCDVLADFYDQ FALMLHESQLDKMPALPAKGNLNLRDILESDFAFAG | 172 |

TABLE 6-continued

Additional Multi-Substitution Variants

| RNA Polymerase Variants | Amino Acid Sequence | SEQ ID NO |
|---|---|---|
| G47A, D506R, S628W, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLAEVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFFE RIKFIEENHENIMACAKSPLENTOMAEQRSPFCFLAFCFEYAGVQHHOLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRWVTKRSVMT LAYGSKEFGFRQQVLEDTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQYRLQPTINTNKDSEIDAHKQESGIAPNFVHSQDGSHLKKTV VWAHEKYGIESFALIHDSFGTIPADAANLFKAVREIMVDTYESCDVLADFYDQ FADQLHESQLDKMPALPAKCNLNLRDILESDFAFAG | 173 |
| G47A, D506L G884 | MNTINTAKNDFSDIELAAIPFNTLADHYGERLAREQLALEHESYEMAEAKFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVCHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMENPQGNDMTKGLLTLAKGKPIGKEGYYWLKIHGANCAGVDKVPFFE RIKFIEENHENIMACAKSPLENTWWAEQLSPFCFLAFCFEYACVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNEVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 174 |
| G47A, D506L, S628W, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKDEAVAYITIKTTLACLTSADNTTVQAVASAIGRAIEDEARFGRIRDLEA RHYKRNVEEQLNKRVGHVYKKAYMQVVEADMLSRGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQLSPFCFLAFCFEYAGVQHHGLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQWLAYCVTRWVTKRSVMT LAYGSKEFGFRQQVLEDTIQPAIDSGKGLMFTQPNQAAGYMAHLIWESVSVTV VAAVEAMNWLKSAAKLLAAEVKDKKTGEILRKRCAVHWVIPDGFEWWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDIYESCDVLADFYDQ FADQLHESQLDKMPALPAKONLNLRDILESDFAFAG | 175 |
| G47A, D653C, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSETIELAPEYAEAIAIRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHYSAMLRDEVGGRAVNLLPSETVQDIYGIVARKVNEILQ ADAINGTDNEVVTVTDENTGEISEKVKLGTKALAGQWLAYGVTRSVTKRSVMT LAYGSKEFGFRQQVLECTIQPAIDSGKGLMFTQFNQAAGYMAKLIWESVSVTV VAAVEAMNWLKSAAKLLAAEVKDKKTGEILRKRCAVHWVIPDGPPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 176 |

TABLE 6-continued

Additional Multi-Substitution Variants

| RNA Polymerase Variants | Amino Acid Sequence | SEQ ID NO |
|---|---|---|
| G47A, D653E, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGGKALAGQWLAYSVTRSVGKRSVMT LAYGSKEFGFRQQVLEETIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQYRLQPTINTNKDSEIDAHKQESGIAPNYVHSQDGSHLRKTV VWAHEKYGIESFALIHDSEGTIPADAANLFKAVREIMVDTYESCDVLADFYDQ FADQLHESQLDKMPALPAKGNLNLRDILESDFAFAG | 177 |
| G47A, R632K, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGYKALACQWLAYSVTRSVTKKSVMT LAYCSKEFGFRQQVLEDTIQPAIDSGKGLMFTQPNQAAGYMAKLIWESVSVTV VAAVEAMNWLKSAAKLLAAEVKDEKTGEILRKRCAVHWVIDDGFPVWQEYKKD IQTRLNLMFLGQFRLQPTINTNKCSEIDAHKQESGIAPNFVHSQDCSHLRKTV VWAHEKYGIESFALIHDSFCTIPADAANLFKAVRETMVDIYESCDVLADFYDQ FADQLHESQLDKMDALFAKGNLNLRDILESDFAFAG | 178 |
| G47A, R632T, G884 | MNTINIAKNDFSDIELAAIPFNTLADHYCERLAREQLALEHESYEMAEARFRK MFERQLKAGEVADNAAAKPLITTLLFKMIARINDWFEEVKAKRGKRFTAFQFL QEIKFEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAFEYAEAIATRAGALAGIS PMFQPCVVPPKPWTGITGGGYWANGRRFLALVRTHSKKALMRYEDVYMFEVYK AINIAQNTAWKINKKVLAVANVITKWKHCPVEDIPAIEREELPMKPEDIDMNP EALTAWKKAAAAVYRKDKARKSRRISLEFMLEQANKPANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYACVQHHCLSYNC SLPLAFDGSCSGIQHFSAMLRDEVGGRAVNLLPSETVQDIYGIVAKKVNEILQ ADAINGTDNEVVTVTDENTGEISEKVKLCYKALAGQWLAYGVTRSVYKTSVMT LAYCSKEFCFRQQVLEDTIQPAIDSCKCLMFTQPNQAACYMAKLIWESVSVTV VAAVEAMNWLKSAAKLLAAEVKDKKTGFILRKRCAVHWVTPDCFPVWQEYKKF IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADCLHESCLDKMFALPAKGNLNLRDILESDFAFAG | 179 |
| G47A, P657W, R632K, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIETTLACLTSADNTTVQAVASAIGRAIEDEAPYGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMND EALTAWKRAAAAVYRKDKARKSRRISLEFMLEQANKFANHKAIWFPYNMDWRG RVYAVSMFNPQCNDMTKGLLTLAKGKPIGKEGYYWLKIHGANCAGVDKVFFFE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKKSVMT LAYGSKEFGFRQQVLEDTIQWAIDSGKGLMFTQFNQAAGYMAHLIWESVSVTV VAAVEAMNWLKSAAKLLAAEVKDKKTGEILRKRCAVHWVTPDGFPVWQEYKKP IQTRLNLMFLGQFRLQRTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 180 |

TABLE 6-continued

Additional Multi-Substitution Variants

| RNA Polymerase Variants | Amino Acid Sequence | SEQ ID NO |
|---|---|---|
| G47A, P657W, R632T, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKDEAVAYITIKTTLACLTSADNTTVQAVASAIGRAIEDEARFGRIRDLEA KHFKKNVEEQLNKRVCHVYKKAFMQVVEADMLSKGLLGCEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKINKHGPVEDIPAIEREELMKPEDIDMNP EALTAWKRAAAAVYRKDKARKSRRYSLEFMLEQANKFANHKAIWFPYNMDWRG RVYAVSMENDQCNDMTKGLLTLAKGKPIGKEGYYWLKIHGANCAGVDKVDFFE RIKFIEENHENIMACAKSPLENTWWAEQDSPFCFLAFCFEYAGVQHHGLSYNC SLPLAFDGSCSGIQHFSAMLRDEVGGRAVNLLFSETVQDIYGIVAKKVNEILQ ADAINGTDNEVVTVTDENTGEISEKVKLCYKALAGQWLAYGVTRSVYKTSVMT LAYCSKEFGFRQQVLEDTIQWAIDSGKGLMFTQPNQAAGYMAKLIWESVSVTV VAAVEAMNWLKSAAKLLAAEVKDKKTGEILRKRCAVHWVTDDGFEWWQEYKKD IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 181 |
| G47A, P657R, R632K, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHYKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKREDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYCVTRSVTKKSVMT LAYGSKEFGFRQQVLEDTIQRAIDSGKGLMFTQPNQAAGYMAHLIWESVSVTV VAAVEAMNWLKSAAKLLAAEVKDKKTGEILRKRCAVHWVIPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDIYESCDVLADFYDQ FADQLHESQLDKMPALPAKGNLNLRDILESDFAFAG | 182 |
| G47A, P657R, R632T, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMCIESIGMVSLHRQNAGVVGQDSETIELAPEYAEATATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHYSAMCRDEVGGRAVNLCPSETVQDIYGIVAKKVNEILQ ADAINGTDNEVVTVTDENTGEISEKVKLGTKALAGQWLAYGVTRSVTKTSVMT LAYGSKEFGFRQQVLEDTIQRAICSGKGLMFTQPNQAAGYMAHLIWESVSVTV VAAVEAMNWLKSAAKLLAAEVKDKKIGEILRKRCAVHWVTPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 183 |
| G47A, P657A, R632K, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPIAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQWLAYSTERSVTKKSVMT LAYGSKEFGFRQQVLEDTIQAAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQYRLQPTINTNKDSEIDAHKQESGIAPNYVHSQDGSHLRKTV VWAHEKYGIESFALIHDSEGTIPADAANLFKAVRETMVDTYESCDVLADFYDQ FADQLHESQLDKMPALPAKGNLNLRDILESDFAFAG | 184 |

TABLE 6-continued

Additional Multi-Substitution Variants

| RNA Polymerase Variants | Amino Acid Sequence | SEQ ID NO |
|---|---|---|
| G47A, P657A, R632T, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALIAWKRAAAAVYRKDKARKSRHISLEFMLEQANKFANHKAIWFPYNMDWRG RVYAVSMFNPQCNDMTKGLLTLAKGKPIGKEGYYWLKIHGANCAGVDKVPFPE RIKFIEENHENIMACAKSPLENTWWAEQDSPFCFLAFCFEYACVQHHCLSYNC SLPLAFDGSCSGIQHFSAMLRDEVGGRAVNLLPSETVQDIYGIVAKKVNEILQ ADAINGTDNEVVTVTDDENTGEISEKVKLGTKALAGQWLAYSVTRSVTKTSVMT LAYGSKEFGFRQQVLEDTIQAAIDSGKGLMFTQPNQAACYMAKLIWESVSVTV VAAVEAMNWLKSAAKLLAAEVKDEKTGEILRKRCAVHWVTDDGFPVWQEYKKD IQTRLNLMFLCQFRLQPTINTNKDSEIDAHKQESGIAPNFVHSQDCSHLRKTV VWAHEKYGIESFALIHDSFCTIPADAANLFKAVRETMVDIYESCDVLADFYDQ FADQLHESQLDKMPALFAKGNLNLRDILESDFAFAG | 185 |
| G47A, D653W, R632K, G884 | MNTINIAKNDFSDIELAAIPFNTLADHYGERLAREQLALEHESYEMAEARFRK MFERQLKAGEVADNAAAKPLITTLLPKMIARINDWEEEVKAKRGKRPIAFQFL QEIKFEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRFLALVRTHSKKALMRYEDVYMFEVYK AINIAQNTAWKINKKVLAVANVITKWKHCPVEDIPAIERFELPMKPEDIDMND EALTAWKKAAAAVYRKDKARKSRRIISLEFMLEQANKFANHKAIWYPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLFSETVQDIYGIVAKKVNEILQ ADAINGTDNEVVTVTDENTGEISEKVKLGTKALAGQWLAYGVTRSVTKKSVMT LAYGSKEFGFRQQVLEWTIQPAIDSGKGLMFTQPNQAAGYMAKLIWESVSVTV VAAVEAMNWLKSAAKLLAAEVKDKKTGEILRKRCAVHWVTPDGFEWWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDIYESCDVLADFYDQ FALMLHESQLDRMFALFAKGNLNLRDILESDFAFAG | 186 |
| G47A, D653W, R632T, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTILACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYR AINIAQNTAWKINKKVLAVANVITKWKHCFVEDIPAIEREELPMKREDIDMNP EALIAWKRAAAAVYRKDKARKSRPISLEFMLEQANKFANHKAIWFPYNMDWRG RVYAVSMFNPQGNDMTKGLLTLAKGKPIGKEGYYWLKIHGANCAGVDKVFFFE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGETSEKVKLGTKALAGQWLAYSVTRSVTKTSVMT LAYGSKEFGFRQQVLEWTIQPAIDSGKGLMFTQPNOAAGYMAHLIWESVSVTV VAAVEAMNWLKSAAKLLAAEVKDKKTGFILRKRCAVHWVIPDGFPVWQEYKKP IQTRLNLMYLGQYRLQPTINTNKDSEIDAHKQESGIAPNFVHSQDGSHLRKTV VWAHEKYGIESFALIHDSFGTIPADAANLFKAVRETMVDIYESCDVLADFYDQ FADQLHESQLDRMDALPAKGNLNLRDILESDFAFAG | 187 |
| G47A, D653W, P657W, R632K, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKFEAVAYITIKTTLACLTSADNTTVQAVASAIGRAIEDEARFGRIRDLEA KHFKKNVEEQLNKRVCHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALIAWKRAAAAVYRKDKARKSRRISLEFMLEQANKFANHKAIWFRYNMDWRG RVYAVSMFNPQGNDMTKGLLTLAKGKPIGKEGYYWLKIHGANCAGVDKVETFE RIKFIEENHENIMACANSPLENTAMAEQDSPYCYLAYCFEYAGVQHHCLSYNC SLPLAFDGSCSGIQHFSAMLRDEVGGRAVNLLPSEIVQDIYGIVAKKVNEILQ ADAINCTDNEVVTVTDENTGEISEKVKLGTKALACQWLAYCVTRSVTKKSVMI LAYCSKEFCFRQQVLEWTIQWAIDSGKGLMFTQPNQAACYMAKLIWESVSVTV VAAVEAMNWLKSAAKLLAAEVKDKKTGEILRKRCAVHWVIPDGFEWWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 188 |

TABLE 6-continued

Additional Multi-Substitution Variants

| RNA Polymerase Variants | Amino Acid Sequence | SEQ ID NO |
|---|---|---|
| G47A, D653W, P657W, R632T, G884 | MNTINIAKNDFSDIELAAIPFNTLADHYGERLAREQLALEHESYEMAEARFRK MFERQLKAGEVADNAAAKPLITTLLPKMIARINDWEEEVKAKRGKRPTAFQFL QEIKPEAVAYITIKTTLACLTSADNTTVQAVASAIGRAIEDEARFGRIRDLEA KHYKKNVEEQLNKRVGHVYKKAYMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEKEELPMKREDIDMNP EALTAWKRAAAAVYRKDKARKSRRISLEFMLEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSEIVQDIYGIVAKKVNEILQ ADAINGTDNEVVTVTDENTGEISEKVKLGTKALAGQWLAYCVTRSVTKTSVMT LAYGSKEFGFRQQVLEWTIQWAICSGKGLMFTQPNQAAGYMAHLIWESVSVTV VAAVEAMNWLKSAAKLLAAEVKDKKTGEILRKRCAVHWVIPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDIYESCDVLADFYDQ FADQLHESQLDKMPALPAKGNLNLRDILESDFAFAG | 189 |
| G47A, D653W, P657R, R632K, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMCIESIGMVSLHRQNAGVVGQDSETIELAPEYAEAIAIRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHYSAMLRDEVGGRAVNLCPSETVQDIYGIVAKKVNEILQ ADAINGTDNEVVTVTDENTGEISEKVKLGTKALAGQWLAYGVTRSVTKKSVMT LAYGSKEFGFRQQVLEWTIQRAIDSGKGLMFTQPNQAAGYMAHLIWESVSVTV VAAVEAMNWLKSAAKLLAAEVKDKKIGEILRKRCAVHWVIPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 190 |
| G47A, D653W, P657R, R632T G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPIAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKTSVMT LAYGSKEFGFRQQVLEWTIQRAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQYRLQPTINTNKDSEIDAHKQESGIAPNYVHSQDGSHLRKTV VWAHEKYGIESFALIHDSEGTIPADAANLFKAVRETMVDTYESCDVLADFYDQ FADQLHESQLDKMPALPAKGNLNLRDILESDFAFAG | 191 |
| G47A, D653W, P657A, R632K, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALIAWKRAAAAVYRKDKARKSRHISLEFMLEQANKFANHKAIWFPYNMDWRG RVYAVSMFNPQCNDMTKGLLTLAKGKPIGKEGYYWLKIHGANCAGVDKVPFPE RIKFIEENHENIMACAKSPLENTWWAEQDSPFCFLAFCFEYACVQHHCLSYNC SLPLAFDGSCSGIQHFSAMLRDEVGGRAVNLLPSETVQDIYGIVAKKVNEILQ ADAINGIDNEVVTVTDENTGEISEKVKLGTKALAGQWLAYSVTRSVTKKSVMT LAYGSKEFGFRQQVLEWTIQAAIDSGKGLMFTQPNQAAGYMAKLIWESVSVTV VAAVEAMNWLKSAAKLLAAEVKDEKTGEILRKRCAVHWVTDDGFPVWQEYKKD IQTRLNLMFLCQFRLQPTINTNKDSEIDAHKQESGIAPNFVHSQDCSHLRKTV VWAHEKYGIESFALIHDSFGTIPADAANLFKAVRETMVDIYESCDVLADFYDQ FADQLHESQLDKMPALFAKGNLNLRDILESDFAFAG | 192 |

TABLE 6-continued

Additional Multi-Substitution Variants

| RNA Polymerase Variants | Amino Acid Sequence | SEQ ID NO |
|---|---|---|
| G47A, D653W, P657A, R632T, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPIAFQFL QEIKFEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRFLALVRTHSKKALMRYEDVYMFEVYK AINIAQNTAWKINKKVLAVANVITKWKHCPVEDIPAIERFELPMKPEDIDMND EALTAWKKAAAAVYRKDKARKSRRISLEFMLEQANKFANHKAIWYPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLFSETVQDIYGIVAKKVNEILQ ADAINGTDNEVVTVTDENTGEISEKVKLGTKALAGQWLAYGVTRSVTKTSVMT LAYCSKEFGFRQQVLEWTIQAAIDSGKGLMFTQPNQAAGYMAKLIWESVSVTV VAAVEAMNWLKSAAKLLAAEVKDKKTGEILRKRCAVHWVTPDGFEWWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDIYESCDVLADFYDQ FALMLHESQLDRMFALFAKGNLNLRDILESDFAFAG | 193 |
| G47A, D653F, R632K, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYR AINIAQNTAWKINKKVLAVANVITKWKHCFVEDIPAIEREELPMKREDIDMNP EALIAWKRAAAAVYRKDKARKSRPISLEFMLEQANKFANHKAIWFPYNMDWRG RVYAVSMFNPQGNDMTKGLLTLAKGKPIGKEGYYWLKIHGANCAGVDKVFFFE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKKSVMT LAYGSKEFGFRQQVLEFTIQPAIDSGKGLMFTQPNQAAGYMAHLIWESVSVTV VAAVEAMNWLKSAAKLLAAEVKDKKTGFILRKRCAVHWVIPDGFPVWQEYKKP IQTRLNLMYLGQYRLQPTINTNKDSEIDAHKQESGIAPNFVHSQDGSHLRKTV VWAHEKYGIESFALIHDSFGTIPADAANLFKAVRETMVDIYESCDVLADFYDQ FADQLHESQLDRMDALPAKGNLNLRDILESDFAFAG | 194 |
| G47A, D653F, R632T, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKFEAVAYITIKTTLACLTSADNTTVQAVASAIGRAIEDEARFGRIRDLEA KHFKKNVEEQLNKRVCHVYKKAFMQVVEADMLSKGLLGGEAWSSWHKEDSIHV CVRCIEMLIESTCMVSLHRQNAGVVGQDSETIELAPEYAEAIATRAGALACIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALIAWKRAAAAVYRKDKARKSRRISLEFMLEQANKFANHKAIWFRYNMDWRG RVYAVSMFNPQGNDMTKGLLTLAKGKPIGKEGYYWLKIHGANCAGVDKVETFE RIKFIEENHENIMACANSPLENTAMAEQDSPYCYLAYCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGTKALACQWLAYCVTRSVTKTSVMT LAYGSKEFCFRQQVLEFTIQPAIESGKGLMFTQPNQAAGYMAKLIWESVSVTV VAAVEAMNWLKSAAKLLAAEVKDKKTGEILRKRCAVHWVIPDGFEWWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 195 |
| G47A, D653F, P657W, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHYKKNVEEQLNKRVGHVYKKAYMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITWNKHGRVEDIPAIEREELPMKREDIDMND EALTAWKRAAAAVYRKDKARKSRRISLEFMLEQANKFANHKAIWETYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAEDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEFTIQWAIDSGKGLMFTQPNQAAGYMAHLIWESVSVTV VAAVEAMNWLKSAAKLLAAEVKDKKTGEILRKRCAVHWVIPDGFPVWQEYKKP IQTRLNLMFLGQFRLQPTINTNKDSEIDAHKQESGIAPNFVHSQDCSHLRKTV VWAHERYGIESHDSTIPADAANLFKAVREIMVDIYESCDVLADFYDQ FADQLHESQLDKMPALPAKGNLNLRDILESDFAFAG | 196 |

TABLE 6-continued

Additional Multi-Substitution Variants

| RNA Polymerase Variants | Amino Acid Sequence | SEQ ID NO |
|---|---|---|
| G47A, D653F, P657W, R632K, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSETIELAPEYAEAIAIRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHYSAMCRDEVGGRAVNLCPSETVQDIYGIVAKKVNEILQ ADAINGTDNEVVTVTDENTGEISEKVKLGTKALAGQWLAYGVTRSVTKKSVMT LAYGSKEFGFRQQVLEFTIQWAIDSGKGLMFTQPNQAAGYMAHLIWESVSVTV VAAVEAMNWLKSAAKLLAAEVKDKKIGEILRKRCAVHWVIPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESCDVLADFYDQ FADQLHESQLDKMPALPAKGNLNLRDILESDFAFAG | 197 |
| G47A, D653F, P657W, R632T, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPIAFQFL QEIKPEAVAYITIKTTLACLIS ADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKTSVMT LAYGSKEFGFRQQVLEFTIQWAIDSGKOLMFTQPNQAAGYMAHLIWESVSVTV VAAVEAMNWLKSAAKLLAAEVKDKKTGEILRKRCAVHWVTPDGFPVWQEYKKP IQTRLNLMFLGQYRLQPTINTNKDSEIDAHKQESGIAPNYVHSQDGSHLRKTV VWAHEKYGIESFALIHDSEGTIPADAANLFKAVRETMVDTYESCDVLADFYDQ FADQLHESQLDKMPALPAKGNLNLRDILESDFAFAG | 198 |
| G47A, D653F, P657R, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLISADNTTVQAVASAIGRAIEDEARFGRIRDLEA KHFKKNVEEQLNKRVGHVYKKAFMQVVEADMLSKGLLGGEAWSSWHKEDSIEV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALIAWKRAAAAVYRKDKARKSRHISLEFMLEQANKFANHKAIWFPYNMDWRG RVYAVSMFNPQCNDMTKGLLTLAKGKPIGKEGYYWLKIHGANCAGVDKVPFPE RIKFIEENHENIMACAKSPLENTWWAEQDSPFCFLAFCFEYACVQHHCLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYCSKEFCFRQQVLEFTIQRAIDSCKCLMFTQPNQAACYMAKLIWESVSVTV VAAVEAMNWLKSAAKLLAAEVKDEKTGEILRKRCAVHWVIDDGFPVWQEYKKD IQTRLNLMFLCQFRLQPTINTNKDSEIDAHKQESGIAPNFVHSQDCSHLRKTV VWAHEKYGIESFALIHDSFGTIPADAANLFKAVRETMVDIYESCDVLADFYDQ FADQLHESQLDKMPALFAKGNLNLRDILESDFAFAG | 199 |
| G47A, D653F, P657R, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGSGYWANGRRFLALVRTHSKKALMRYEDVYMFEVYK AINIAQNTAWKINKKVLAVANVITKWKHCPVEDIPAIERFELPMKPEDIDMND EALTAWKKAAAAVYRKDKARKSRRISLEFMLEQANKFANHKAIWYPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFGFEYAGVQHHGLSYNC SLPLAFDGSCSGIQHFSAMLRDEVGGRAVNLLFSETVQDIYGIVAKKVNEILQ | 200 |

TABLE 6-continued

Additional Multi-Substitution Variants

| RNA Polymerase Variants | Amino Acid Sequence | SEQ ID NO |
|---|---|---|
| | ADAINGTDNEVVTVTDENTGETSEKVKLGTKALAGQWLAYGVTRSVTKKSVMT<br>LAYGSKEFGFRQQVLEFTIQRAIDSGKGLMFTQPNQAAGYMAKLIWESVSVTV<br>VAAVEAMNWLKSAAKLLAAFVKDRKTGEILRKKCAVHWVIFDGFFVWQEYKKF<br>IQTRLNLMFLGQFRLQPTINTNKGSEIDAHKQESGIAPNFVHSQDGSHLRKTV<br>VWAHEKYGIESFALIHDSFGTIPADAANLFKAVRETMVDIYESCDVLADFYDQ<br>FALMLHESQLDRMFALFAKGNLNLRDILESDFAFAG** | |
| G47A, D653F, P657R, R632T, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARYGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYR<br>AINIAQNTAWKINKKVLAVANVITKWKHCFVEDIPAIEREELPMKREDIDMNP<br>EALIAWKRAAAAVYRKDKARKSRPISLEFMLEQANKFANHKAIWFPYNMDWRG<br>RVYAVSMFNFQGNDMTKGLLTLAKGKPIGKEGYYWLKIHGANCAGVDKVFFFE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKTSVMT<br>LAYGSKEFGFRQQVLEFTIQRAIDSGKGLMFTQPNOAAGYMAHLIWESVSVTV<br>VAAVEAMNWLKSAAKLLAAEVKDKKTGFILRKRCAVHWVIPDGFPVWQEYKKP<br>IQTRLNLMYLGQYRLQPTINTNKDSEIDAHKQESGIAPNFVHSQDGSHLRKTV<br>VWAHEKYGIESFALIHDSFGTIPADAANLFKAVRETMVDIYESCDVLADFYDQ<br>FADQLHESQLDRMDALPAKGNLNLRDILESDFAFAG** | 201 |
| G47A, D653F, P657A, G884 | MNTINIAKNDFSDIELAAIPFNILADHYGERLAREQLALEHESYEMAEAKFRK<br>MFERQLKAGEVADNAAAKPLITTLLPKMIARINDWFEEVKAKRGKRPTAFQFL<br>QEIKFEAVAYITIKTTLACLTSADNTTVQAVASAIGRAIEDEARFGRIRDLEA<br>KHFKKNVEEQLNKRVCHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKKVLAVANVITKWKHCPVEDIPAIEREELPMKPEDIDMNP<br>EALIAWKRAAAAVYRKDKARKSRRISLEFMLEQANKFANHKAIWFRYNMDWRG<br>RVYAVSMFNFQGNDMTKGLLTLAKGKPIGKEGYYWLKIHGANCAGVDKVETFE<br>RIKFIEENHENIMACAKSPLENTWWAEQDSPYCYLAYCFEYAGVQHHCLSYNC<br>SLPLAFDGSCSGIQHFSAMLRDEVGGRAVNLLPSEIVQDIYGIVAKKVNEILQ<br>ADAINGTDNEVVTVTDENTGEISEKVKLGTKALAGQWLAYSVTRSVTKRSVMT<br>LAYGSKEFCFRQQVLEFTIQAAIDSCKCLMFTQPNQAACYMAKLIWESVSVTV<br>VAAVEAMNWLKSAAKLLAAEVKDKKTGEILRKRCAVHWVIPDGFEWWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG** | 202 |
| G47A, D653F, P657A, R632K, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHYKKNVEEQLNKRVGHVYKKAYMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVEDIPAIEREELPMKREDIDMNP<br>EALTAWKRAAAAVYRKDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAEDGSCSGIQHFSAMLRDEVGGRAVNLLPSETVQDIYGIVAKKVNEILQ<br>ADAINGTDNEVVTVTDENTGEISEKVKLGTKALAGQWLAYCVTRSVTKKSVMT<br>LAYGSKEFGFRQQVLEFTIQAAIDSGKGLMFTQPNQAAGYMAHLIWESVSVTV<br>VAAVEAMNWLKSAAKLLAAEVKDKKTGEILRKRCAVHWVIPDGFPVWQEYKKP<br>IQTRLNLMFLCQFRLQPTINTNKDSEIDAHKQESGIAPNFVHSQDCSHLRKTV<br>VWAHEKYGIESFALIHDSFGTIPADAANLFKAVRETMVDIYESCDVLADFYDQ<br>FADQLHESQLDKMPALPAKGNLNLRDILESDFAFAG** | 203 |
| G47A, D653F, P657A, R632T, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSACNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIAIRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRC<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKTSVMT<br>LAYGSKEFGFRQQVLEFTIQA**AIDSGKGLMFTQPNQAAGYMAHLIWESVSVTV | 204 |

TABLE 6-continued

Additional Multi-Substitution Variants

| RNA Polymerase Variants | Amino Acid Sequence | SEQ ID NO |
|---|---|---|
| | VAAVEAMNWLKSAAKLLAAEVKDKKIGEILRKRCAVHWVIPDGFPVWQEYKKP<br>IQTRLNLMFLGQFRLQPTINTNKESEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | |
| G47A, D653Y, R632K, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRDISLEFMLEQANKFANHKAIWFRYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKKSVMT<br>LAYGSKEFGFRQQVLEYTIQPAIDSGKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLGQYRLQPTINTNKDSEIDAHKQESGIAPNYVHSQDGSHLRKTV<br>VWAHEKYGIESFALIHDSEGTIPADAANLFKAVRETMVDTYESCDVLADFYDQ<br>FADQLHESQLDKMPALPAKGNLNLRDILESDFAFAG | 205 |
| G47A, D653Y, R632T, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALIAWKRAAAAVYRKDKARKSRRISLEFMLEQANKFANHKAIWFPYNMDWRG<br>RVYAVSMFNPQCNDMTKGLLTLAKCKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGYKALAGQWLAYSVTRSVYKTSVMT<br>LAYCSKEFCFRQQVLEYTIQPAIDSGKGLMFTQPNQAACYMAKLIWESVSVTV<br>VAAVEAMNWLKSAAKLLAAEVKDEKTGEILRKRCAVHWVIPDGFPVWQEYKKP<br>IQTRLNLMFLGQFRLQPTINTNKDSEIDAHKQESGIAPNFVHSQDCSHLRKTV<br>VWAHEKYGIESFALIHDSFGTIPADAANLFKAVRETMVDIYESCDVLADFYDQ<br>FADQLHESQLDKMPALPAKGNLNLRDILESDFAFAG | 206 |
| G47A, D653Y, P657W, G884 | MNTINIAKNDFSDIELAAIPFNTLADHYGERLAREQLALEHESYEMAEARFRK<br>MFERQLKAGEVADNAAAKPLITTLLPKMIARINDWEEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSRGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVEDIPAIERFELPMKPEDIDMND<br>EALTAWKRAAAAVYRKDKARKSRRISLEFMLEQANKFANHKAIWYRYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTCEISEKVKLGYKALAGQWLAYGVTRSVYKRSVMT<br>LAYGSKEFGFRQQVLEYTIQWAIDSGKGLMFTQPNQAAGYMAKLIWESVSVTV<br>VAAVEAMNWLKSAAKLLAAFVKDRKTGEILRKKCAVHWVTPDGFPVWQEYKKF<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | 207 |
| G47A, D653Y, P657W, R632K, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKGKRPTAFQFL<br>QEIKPEAVAYPTIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMRQPCVVPPKPWTGITGSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRPISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVCGRAVNLLPSETVQDIYGIVAKKVNEILQ<br>ADAINGTDNEVVTVTDENTGEISEKVKLGCKALAGQWLAYGVTRSVCKKSVMT<br>LAYGSKEFGFRQQVLEYTIQWAIDSGKGLMFTQPNQAAGYMAHLIWESVSVTV<br>VAAVEAMNWLKSAAKLLAAEVKDRKTGEILRKRCAVHWVTPDGFPVWQEYKKP<br>IQTRLNLMYLGQYRLQPTINTNKDSEIDAHKQESGIAPNFVHSQDGSHLRKTV | 208 |

TABLE 6-continued

Additional Multi-Substitution Variants

| RNA Polymerase Variants | Amino Acid Sequence | SEQ ID NO |
|---|---|---|
| | VWAHEKYGIESFALIHDSFGTIPADAANLFKAVRETMVDIYESCDVLADFYDQ<br>FADQLHESQLDRMPALPAKGNLNLRDILESDFAFAG | |
| G47A, D653Y,<br>P657W, R632T,<br>G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRCKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACARSPLENTAMAEQDSPYCYLAYCFEYACVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLCYKALACQWLAYCVTRSVYKTSVMT<br>LAYGSKEFGFRQQVLEYTIQWAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | 209 |
| G47A, D653Y,<br>P657R, G884 | MNTINIAKNDFSDIELAAIPFNTLADHYGERLAREQLALEHESYEMAEARFRK<br>MFERQLKAGEVADNAAAKPLITTLLPKMIARINDWEEEVKAKRGKRPIAFQFL<br>QEIKPEAVAYITIKTTLACLTSADNTTVQAVASAIGRAIEDEARFGRIRDLEA<br>KHYKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGPRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKRSVMT<br>LAYGSKEFGFRQQVLEYTIQRAIDSGKGLMFTQPNQAAGYMAHLIWESVSVTV<br>VAAVEAMNWLKSAAKLLAAEVKDKKTGEILRKRCAVHWVIPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDIYESCDVLADFYDQ<br>FADQLHESQLDKMPALPAKGNLNLRDILESDFAFAG | 210 |
| G47A, D653Y,<br>P657R, R632K<br>G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESIGMVSLHRQNAGVVGQDSETIELAPEYAEAIAIRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLCPSETVQDIYGIVARKVNEILQ<br>ADAINGTDNEVVTVTDENTGEISEKVKLGTKALAGQWLAYGVTRSVTKKSVMT<br>LAYGSKEFGFRQQVLEYTIQRAIDSGKGLMFTQPNQAAGYMAHLIWESVSVTV<br>VAAVEAMNWLKSAAKLLAAEVKDKKIGEILRKRCAVHWVIPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | 211 |
| G47A, D653Y,<br>P657R, R632T<br>G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLISADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRDISLEFMLEQANKFANHKAIWFRYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGVKALAGQWLAYGVTRSVTKTSVMT<br>LAYGSKEFGFRQQVLEYTIQRAIDSGKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLGQYRLQPTINTNKDSEIDAHKQESGIAPNYVHSQCGSHLRKTV<br>VWAHEKYGIESFALIHDSEGTIPADAANLFKAVRETMVDTYESCDVLADFYDQ<br>FADQLHESQLDKMPALPAKGNLNLRDILESDFAFAG | 212 |

TABLE 6-continued

Additional Multi-Substitution Variants

| RNA Polymerase Variants | Amino Acid Sequence | SEQ ID NO |
|---|---|---|
| G47A, D653Y, P657A, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRHISLEFMLEQANKFANHKAIWFPYNMDWRG<br>RVYAVSMFNPQCNDMTKGLLTLAKGKPIGKEGYYWLKIHGANCAGVDKVPFPE<br>RIKFIEENHENIMACAKSPLENTWWAEQDSPFCFLAFCFEYACVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKRSVMT<br>LAYGSKEFCFRQQVLEYTIQAAIDSGKGLMFTQPNQAAGYMAKLIWESVSVTV<br>VAAVEAMNWLKSAAKLLAAEVKDEKTGEILRKRCAVHWVTDDGFPVWQEYKKD<br>IQTRLNLMFLCQFRLQPTINTNKDSEIDAHKQESGIAPNFVHSQDCSHLRKTV<br>VWAHEKYGIESFALIHDSFCTIPADAANLFKAVRETMVDIYESCDVLADFYDQ<br>FADQLHESQLDKMPALFAKGNLNLRDILESDFAFAG | 213 |
| G47A, D653Y P657A, R632K G884 | MNTINIAKNDFSDIELAAIPFNTLADHYGERLAREQLALEHESYEMAEARFRK<br>MFERQLKAGEVADNAAAKPLITTLLPKMIARINDWEEEVKAKROKRPIAFQFL<br>QEIKFEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKFWTGITGSGYWANGRRPLALVRTHSKKALMRYEDVYMFEVYK<br>AINIAQNTAWKINKKVLAVANVITKWKHCPVEDIPAIERFELPMKPEDIDMND<br>EALTAWKKAAAAVYRKDKARKSRRISLEFMLEQANKFANHKAIWYPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYGVTRSVTKKSVMT<br>LAYGSKEFGFRQQVLEYTIQAAIDSGKGLMFTQPNQAAGYMAKLIWESVSVTV<br>VAAVEAMNWLKSAAKLLAAFVKDRKTGEILRKKCAVHWVIFDGFFVWQEYKKF<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDIYESCDVLADFYDQ<br>FALMLHESQLDRMFALFAKGNLNLRDILESDFAFAG | 214 |
| G47A, D653Y P657A, R632T, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARYGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYR<br>AINIAQNTAWKINKKVLAVANVITKWKHGFVEDIPAIEREELPMKPEDIDMNP<br>EALTAWKRAAAAVYRKDKARKSRPISLEFMLEQANKFANHKAIWFPYNMDWRG<br>RVYAVSMFNPQGNDMTKGLLTLAKGKPIGKEGYYWLKIHGANCAGVDKVFFFE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKTSVMT<br>LAYGSKEFGFRQQVLEYTIQAAIDSGKGLMFTQPNOAAGYMAHLIWESVSVTV<br>VAAVEAMNWLKSAAKLLAAEVKDKKTGFILRKRCAVHWVTPDGFPVWQEYKKP<br>IQTRLNLMYLGQYRLQPTINTNKDSEIDAHKQESGIAPNFVHSQDGSHLRKTV<br>VWAHEKYGIESFALIHDSFGTIPADAANLFKAVRETMVDIYESCDVLADFYDQ<br>FADQLHESQLDRMDALPAKGNLNLRDILESDFAFAG | 215 |
| G47A, D653T, R632K, G884 | MNTINIAKNDFSDIELAAIPFNTLADHYGERLAREQLALEHESYEMAEAKFRK<br>MFERQLKAGEVADNAAAKPLITTLLPKMIARINDWFEEVKAKRGKRPIAFQFL<br>QEIKFEAVAYITIKTTLACLTSADNTTVQAVASAIGRAIEDEARFGRIRDLEA<br>KHFKKNVEEQLNKRVCHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFRYNMDWRG<br>RVYAVSMFNPQGNDMTKGLLTLAKGKPIGKEGYYWLKIHGANCAGVDKVETFE<br>RIKFIEENHENIMACAKSPLENTWWAEQDSPYCYLAYCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALACQWLAYCVTRSVTKKSVMT | 216 |

TABLE 6-continued

Additional Multi-Substitution Variants

| RNA Polymerase Variants | Amino Acid Sequence | SEQ ID NO |
|---|---|---|
| | LAYGSKEFCFRQQVLETTIQPAIDSGKGLMFTQPNQAAGYMAKLIWESVSVTV<br>VAAVEAMNWLKSAAKLLAAEVKDKKTGEILRKRCAVHWVIPDGFEWWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | |
| G47A, D653T, R632T, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHYKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGPRRPLALVRTHSKKALMRYEDVYMPEVYK<br>AINIAQNTAWKINKKVLAVANVITKWKHGPVEDIPAIEREELPMKPEDIDMNP<br>EALTAWKRAAAAVYRKDKARKSRRISLEFMLEQANKFANHKAIWETYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYCVTRSVTKTSVMT<br>LAYGSKEFGFRQQVLETTIQPAIDSGKGLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDIYESCDVLADFYDQ<br>FADQLHESQLDKMPALPAKGNLNLRDILESDFAFAG | 217 |
| G47A, D653T, P657W, R632K, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRGIEMLIESIGMVSLHRQNAGVVGQDSETIELAPEYAEAIAIRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAYDGSCSGIQHYSAMCRDEVGGRAVNLCPSETVQDIYGIVAKKVNEILQ<br>ADAINGTDNEVVTVTDENTGEISEKVKLGTKALAGQWLAYGVTRSVTKKSVMT<br>LAYGSKEFGFRQQVLETTIQWAIDSGKGLMFTQPNQAAGYMAHLIWESVSVTV<br>VAAVEAMNWLKSAAKLLAAEVKDKKIGEILRKRCAVHWVTPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FADQLHESQLDKMPALPAKGNLNLRDILESDFAFAG | 218 |
| G47A, D653T, P657W, R632T, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRDISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSEIVQDIYGIVAKKVNEILQ<br>ADAINGTDNEVVTVTDENTGEISEKVKLGTKALAGQWLAYSTGRSVTKTSVMT<br>LAYGSKEFGFRQQVLETTIQWAIDSGKQLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLGQYRLQPTINTNKDSEIDAHKQESGIAPNYVHSQDGSHLRKTV<br>VWAHEKYGIESFALIHDSEGTIPADAANLFKAVRETMVDTYESCDVLADFYDQ<br>FADQLHESQLDKMPALPAKGNLNLRDILESDFAFAG | 219 |
| G47A, D653T, P657R, R632K, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRG<br>RVYAVSMFNPQCNDMTKGLLTLAKGKPIGKEGYYWLKIHGANCAGVDKVPFPE<br>RIKFIEENHENIMACAKSPLENTWWAEQDSPFCFLAFCFEYACVQHHCLSYNC<br>SLPLAFDGSCSGIQHFSAMLRDEVGGRAVNLLPSEIVQDIYGIVAKKVNEILQ<br>ADAINGTDNEVVTVTDENTGEISEKVKLGTKALAGQWLAYSVTRSVTKKSVMT<br>LAYCSKEFCFRQQVLETTIQRAIDSCKCLMFTQPNQAACYMAKLIWESVSVTV<br>VAAVEAMNWLKSAAKLLAAEVKDEKTGEILRKRCAVHWVTDDGFPVWQEYKKD | 220 |

TABLE 6-continued

Additional Multi-Substitution Variants

| RNA Polymerase Variants | Amino Acid Sequence | SEQ ID NO |
|---|---|---|
| | IQTRLNLMFLCQFRLQPTINTNKDSEIDAHKQESGIAPNFVHSQDCSHLRKTV<br>VWAHEKYGIESFALIHDSFGTIPADAANLFKAVRETMVDIYESCDVLADFYDQ<br>FADQLHESQLDKMPALFAKGNLNLRDILESDFAFAG | |
| G47A, D653T, P657R, R632T G884 | MNTINIAKNDFSDIELAAIPFNTLADHYGERLAREQLALEHESYEMAEARFRK<br>MFERQLKAGEVADNAAAKPLITTLLPKMIARINDWEEEVKAKROKRPIAFQFL<br>QEIKFEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRFLALVRTHSKKALMRYEDVYMPEVYK<br>AINIAQNTAWKINKKVLAVANVITKWKHCPVEDIPAIERFELPMKPEDIDMND<br>EALTAWKKAAAAVYRKDKARKSRRISLEFMLEQANKFANHKAIWYPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLFSETVQDIYGIVAKKVNEILQ<br>ADAINGTDNEVVTVTDENTGEISEKVKLGTKALAGQWLAYGVTRSVTKTSVMT<br>LAYGSKEFGFRQQVLETTIQRAIDSGKGLMFTQPNQAAGYMAKLIWESVSVTV<br>VAAVEAMNWLKSAAKLLAAFVKDRKTGEILRKKCAVHWVIFDGFFVWQEYKKF<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDIYESCDVLADFYDQ<br>FALMLHESQLDRMFALFAKGNLNLRDILESDFAFAG | 221 |
| G47A, D653T, P657A, R632K G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYR<br>AINIAQNTAWKINKKVLAVANVITKWKHCFVEDIPAIEREELPMKPEDIDMNP<br>EALTAWKRAAAAVYRKDKARKSRPISLEFMLEQANKFANHKAIWFPYNMDWRG<br>RVYAVSMFNFQGNDMTKGLLTLAKGKPIGKEGYYWLKIHGANCAGVDKVFFFE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKKSVMT<br>LAYGSKEFGFRQQVLETTIQAAIDSGKGLMFTQPNOAAGYMAHLIWESVSVTV<br>VAAVEAMNWLKSAAKLLAAEVKDKKTGFILRKKRCAVHWVIPDGFPVWQEYKKP<br>IQTRLNLMYLGQYRLQPTINTNKDSEIDAHKQESGIAPNFVHSQDGSHLRKTV<br>VWAHEKYGIESFALIHDSFGIIPADAANLFKAVRETMVDIYESCDVLADFYDQ<br>FADQLHESQLDRMDALPAKGNLNLRDILESDFAFAG | 222 |
| G47A, D653T, P657A, R632T, G884 | MNTINIAKNDFSDIELAAIPFNTLADHYGERLAREQLALEHESYEMAEAKFRK<br>MFERQLKAGEVADNAAAKPLITTLLPKMIARINDWFEEVKAKRGKRPTAFQFL<br>QEIKFEAVAYITIKTTLACLTSADNTTVQAVASAIGRAIEDEARFGRIRDLEA<br>KHFKKNVEEQLNKRVCHVYKKAFMQVVEADMLSKGLLGGEAWSSWHKEDSIHV<br>CVRCIEMLIESTCMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFRYNMDWRG<br>RVYAVSMFNFQGNDMTKGLLTLAKGKPIGKEGYYWLKIHGANCAGVDKVETFE<br>RIKFIEENHENIMACAKSPLENTWWAEQDSPYCYLAYCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALACQWLAYCVTRSVTKTSVMT<br>LAYGSKEFCFRQQVLETTIQAAIDSGKGLMFTQPNQAACYMAKLIWESVSVTV<br>VAAVEAMNWLKSAAKLLAAEVKDKKTGEILRKKCAVHWVTPDGFEWWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESGDVLADFYDQ<br>FADQLHESQLDKMPALPAKGNLNLRDILESDFAFAG | 223 |
| G47A, D653K, R632K, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPIAFQFL<br>QEIKPEAVAYITIKTTLACLTSADNTTVQAVASAIGRAIEDEARFGRIRDLEA<br>KHYKKNVEEQLNKRVGHVYKKAYMQVVEADMLSNGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGPRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWETYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLFLAFDGSCSGIQHFSAMLRDEVGGRAVNLLPSETVQDIYGIVAKKVNEILQ | 224 |

TABLE 6-continued

Additional Multi-Substitution Variants

| RNA Polymerase Variants | Amino Acid Sequence | SEQ ID NO |
|---|---|---|
| | ADAINGTDNEVVTVTDENTGEISEKVKLGTKALAGQWLAYCVTRSVTKKSVMT<br>LAYGSKEFGFRQQVLEKTIQPAIDSGKGLMFTQPNQAAGYMAHLIWESVSVTV<br>VAAVEAMNWLKSAAKLLAAEVKDKKTGEILRKRCAVHWVTPDGFEWWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESGDVLADFYDQ<br>FADQLHESQLDKMPALPAKGNLNLRDILESDFAFAG | |
| G47A, D653K, R632T, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLISADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESIGMVSLHRQNAGVVGQDSETIELAPEYAEAIAIRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRC<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAYDGSCSGIQHFSAMLRDEVGGRAVNLLPSETVQDIYGIVAKKVNEILQ<br>ADAINGTDNEVVTVIDENTGEISEKVKLGTKALAGQWLAYGVTRSVTKSVMT<br>LAYGSKEFGFRQQVLEKTIQPAIDSGKGLMFTQPNQAAGYMAHLIWESVSVTV<br>VAAVEAMNWLKSAAKLLAAEVKDKKIGEILRKRCAVHWVIPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESGDVLADFYDQ<br>FADQLHESQLDKMPALPAKGNLNLRDILESDFAFAG | 225 |
| G47A, D653K, P657W, R632K, G884 | MNTINIAKNDFSDIELAAIDFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRPISLEFMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSTERSVTKKSVMT<br>LAYGSKEFGFRQQVLEKTIQWAIDSGKOLMFTQPNQAAGYMAHLIWESVSVTV<br>VAAVEAMNWLKSAAKLLAAEVKDKKTGEILRKRCAVHWVTPDGFPVWQEYKKP<br>IQTRLNLMFLGQYRLQPTINTNKDSEIDAHKQESGIAPNYVHSQDGSHLRKTV<br>VWAHEKYGIESFALIHDSEGTIPADAANLFKAVRETMVDTYESCDVLADFYDQ<br>FADQLHESQLDKMPALPAKGNLNLRDILESDFAFAG | 226 |
| G47A, D653K, P657W, R632T, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFPYNMDWRG<br>RVYAVSMFNPQCNDMTKGLLTLAKCKPIGKECYYWLKIHGANCACVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGYKALAGQWLAYSVTRSVYKTSVMT<br>LAYCSKEFCFRQQVLEKTIQWAIDSGKGLMFTQPNQAAGYMAKLIWESVSVTV<br>VAAVEAMNWLKSAAKLLAAEVKDEKTGEILRKRCAVHWVIPDGFPVWQEYKKP<br>IQTRLNLMFLGQFRLQPTINTNKDSEIDAHKQESGIAPNFVHSQDCSHLRKTV<br>VWAHEKYGIESFALIHDSFGTIPADAANLFKAVRETMVDTYEGDVLADFYDQ<br>FADQLHESQLDKMPALPAKGNLNLRDILESDFAFAG | 227 |
| G47A, D653K, P657R, R632T, G884 | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSRGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIERFELPMKPEDIDMND<br>EALTAWKRAAAAVYRKDKARKSRRISLEFMLEQANKFANHKAIWYRYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGYKALAGQWLAYGVTRSVTKKSVMT<br>LAYGSKEFGFRQQVLEKTIQRAIDSGKGLMFTQPNQAAGYMAKLIWESVSVTV | 228 |

TABLE 6-continued

Additional Multi-Substitution Variants

| RNA Polymerase Variants | Amino Acid Sequence | SEQ ID NO |
|---|---|---|
| | VAAVEAMNWLKSAAKLLAAFVKDRKTGFILRKKCAVHWVTPDGFFVWQEYKKF ICIRLNLMLFGQFRLQPTINTNKDSEIDAHKQESGIAPNFVHSQDGSHLRKIV VWAHEKYGIESFALIHDSFGTIPADAANLFKAVRETMVDTYESCDVLADFYDQ FADGLHESOLDRmFALFAKGNLNLRDILESDFAFAG | |
| G47A, D653K, P657R, R632T, G884 | MNTINIAKNDFSDIELAAIPFNTLADHYGERLAREQLALEHESYEMAEARFRK MFERQLKAGEVADNAAAKPLITTLLPKMIARINDWFEEVKAKKGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMRQPCVVPPKPWTGITGSGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSCIQHFSAMLRDEVCGRAVNLLPSETVQDIYGIVAKKVNEILQ ADAINGTDNEVVTVTDENTGEISEKVKLGCKALAGQWLAYGVTRSVCKTSVMT LAYGSKEFGFRQQVLEKTIQRAIDSGKGLMFTQPNQAAGYMAHLIWESVSVTV VAAVEAMNWLKSAAKLLAAEVKDRKTGFILRKKRCAVHWVIPDGFPVWQEYKKP IQTRLNLMYLGQYRLQPTINTNKDSEIDAHKQESGIAPNFVHSQDGSHLRKTV VWAHEKYGIESFALIHDSFGTIPADAANLFKAVRETMVDIYESCDVLADFYDQ FADQLHESQLDRMPALPAKCNLNLRDILESDFAFAG | 229 |
| G47A, D653K, P657A, R632K, G884 | MNTINIAKNDRSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDINALEREELPMKPEDIDMNP EALTAWKRAAAAVYRKDKARKSRRISLEFMLEQANKFANHKAIWFRYNMDWRG RVYAVSMFNPQGNDMTKGLLTLAKGKPIGKEGYYWLKIHGANCAGVDKVPFPE RIKFIEENHENIMACAKSPLENTWWAEQDSPYCYLAYCFEYACVQHHCLSYNC SLPLAFDGSCSGIQHFSAMLRDEVGGRAVNLLPSETVQDIYGIVAKKVNEILQ ADAINGTDNEVVTVTDENTGEISEKVKLCYKALAGQWLAYGVTRSVYKKSVMT LAYCSKEFGFRQQVLEKTIQAAIESCKCLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDGSHLRKTV VWAHEKYGIESFALIHDSFGTIPADAANLFKAVRETMVDTYESGDVLADFYDQ FADQLHESQLDKMPALPAKGNLNLRDILESDFAFAG | 230 |
| G47A, R632T, D653K, P657A, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKKVGHVYKKAYMQVVEADMLSKGLLGGEAWSSWHKEDSIHV GVRCIEMLIESTGMVSLHRQNAGVVGQDSETIELAPEYAEAIATRAGALAGIS PMRQPCVVPPKPWTGITGSGYWANGRRPLALVRTHSKKALMRYEDVYMPEVYK AINIAQNTAWKINKKVLAVANVITKWKHCRVEDIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFPE RIKFTEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKTSVMT LAYGSKEFGFRQQVLEKTIQAAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDGSHLRKTV VWAHENYGIESFALIHDSFGTIPADAANLFKAVRETMVDTYESCDVLADFYDQ FADQLHESQLDKMPALPAKGNLNLRDILESDFAFAG | 231 |
| G47A, F880Y, G884 | MNTINIAKNDFSDIELAAIPFNTLADHYGERLAREQLALEHESYEMAEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESIGMVSLHRQNAGVVGQDSETIELAPEYAEAIAIRAGALAGIS PMQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRKDKARKSRRISLEFMLEQANKFANHKAIWFPYNMDWRC RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLEDTIQPAIDSGKGLMFTQPNQAAGYMAKLIWESVSVTV VAAVEAMNWLKSAAKLLAAEVKDKKIGEILRKRCAVHWVTPDGFPVWQEYKKP IQTRLNLMFLGQFRLQPTINTNKDSEIDAHKQESGIAPNFVHSQDGSHLRKTV | 232 |

TABLE 6-continued

Additional Multi-Substitution Variants

| RNA Polymerase Variants | Amino Acid Sequence | SEQ ID NO |
|---|---|---|
| | VWAHEKYGIESFALIHDSFGTIPADAANLFKAVRETMVDTYESGDVLADFYDQ<br>FADQLHESQLDKMPALPAKGNLNLRDILESDYAFAG | |
| G47A, F880Y, G884S | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVEDIPAIEREELPMKPEDIDMND<br>EALTAWKRAAAAVYRKDKARKSRDISLEFMLDQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKRSVMT<br>LAYGSKEFGFRQQVLEDTIQPAIDSGKGLMFTQPNQAAGYMAKLIWESVSVTV<br>VAAVEAMNWLKSAAKLLAAEVKDKKTGEILRKRCAVHWVTPDGFPVWQEYKKP<br>IQTRLNLMFLGQYRLQPTINTNKDSEIDAHKQESGIAPNYVHSQDGSHLKKTV<br>VWAHEKYGIESFALIHDSEGTIPADAANLFKAVRETMVDTYESGDVLADFYDQ<br>FADQLHESQLDKMPALPAKGNLNLRDILESDYAFAS | 233 |
| G47A, F880Y, G884T | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRPLALVRTHSKKALMRYEDVYMPEVYK<br>AINIAQNTAWKINKKVLAVANVITKWKHCPVEDIPAIEREELPMKPEDIDMNP<br>EALTAWKRAAAAVYRKDKARKSRRISLEFMLEQANKFANHKAIWFDYNMDWRG<br>RVYAVSMFNPQCNDMTKGLLTLAKGKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALACQWLAYSVTRSVTKRSVMT<br>LAYGSKEFGFRQQVLEDTIQPAIDSGKGLMFTQPNQAAGYMAKLIWESVSVTV<br>VAAVEAMNWLKSAAKLLAAEVKDEKTGEILRKRCAVHWVIDDGFEWWQEYKKD<br>IQTRLNLMFLGQFRLQPTINTNKDSEIDAHKQESGIAPNFVHSQDCSHLRKTV<br>VWAHEKYGIESFALIHDSFGTIPADAANLFKAVRETMVDTYESGDVLADFYDQ<br>FADQLHESQLDKMDALFAKGNLNLRDILESDYAFAT | 234 |
| G47A, F880Y, G884P | MNTINIAKNDFSDIELAAIPFNTLADHYGERLAREQLALEHESYEMAEARFRK<br>MFERQLKAGEVADNAAAKPLITTLLPKMIARINDWFEEVKAKRGKRPTAFQFL<br>QEIKFEAVAYITIKTTLACLTSADNTTVQAVASAIGRAIEDEARFGRIRDLEA<br>KHFKKNVEEQLNKRVCHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGSGYWANGRRFLALVRTHSKKALMRYEDVYMFEVYK<br>AINIAQNTAWKINKKVLAVANVITKWKHCPVEDIPAIEREELPMKPEDIDMNP<br>EALTAWKKAAAAVYRKDKARKSRRISLEFMLEQANKFANHKAIWYPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYACVQHHCLSYNC<br>SLPLAFDGSCSGIQHFSAMLRDEVGGRAVNLLFSETVQDIYGIVAKKVNEILQ<br>ADAINGTDNEVVTVTDENTGISEKVKLGTKALAGQVILAYGVTRSVTKRSVMT<br>LAYGSKEFGFRQQVLEDTIQPAIDSGKGLMFTQPNQAACYMAHLIWESVSVTV<br>VAAVEAMNWLKSAAKLLAAEVKDKKTGEILRKRCAVHWVTPDGFEWWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESCDVLADFYDQ<br>FAIMLHESQLDKMPALPAKGNLNLRDILESDYAFAP | 235 |
| E350W, D351V | MNTINIAKNDFSDIELAAIPFNTLADHYGERLAREQLALEHESYEMCEARFRK<br>MFERQLKACEVADNAAAKPLITTLLPKMIARINDWFEEVKAKRGKRPTAFQFL<br>QEIKPEAVAYITIKTTLACLTSADNTTVQAVASAIGRAIEDEAKFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITCSGYWANGRRPLALVRTHSKKALMRYEDVYMPEVYK<br>AINIAQNTAWKINKKVLAVANVITKWKHCFVWVIFAIEREELPMKPEDIDMND<br>EALTAWKRAAAAVYRKDKARKSRRISLEFMLEQANKFANHKAIWFPYNMDWRG<br>RVYAVSMFNPQGNDMTKGLLTLAKGKPIGKEGYYWLKIHGANCAGVDKVPFFE<br>RIKFIEENHENIMACAKSPLENTWWAEQDSPFCFLAFCFEYACVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVGLGTKALAGQWLAYGVTRSVTKRSVMT<br>LAYGSKEFGFRQQVLEDTIQPAIDSGKGLMFTQFNQAAGYMAHLIWESVSVTV<br>VAAVEAMNWLKSAAKLLAAEVKDKKTGEILRKRCAVHWVTPDGFPVWQEYKKP<br>IQTRLNLMYLGQYRLQPTINTNKDSEIDAHKQESGIAPNFVHSQDGSHLRKTV<br>VWAHEKYGIESFALIHDSFGTIPADAANLFKAVRETMVDTYESGDVLADFYDQ<br>FADQLHESQLDKMPALPAKGNLNLRDILESDFAFA | 236 |

TABLE 6-continued

Additional Multi-Substitution Variants

| RNA Polymerase Variants | Amino Acid Sequence | SEQ ID NO |
|---|---|---|
| E350W, K387N | MNTINIAKNDFSDIELAAIPFNTLADHYGERLAREQLALEHESYEMGEARFRK MFERQLKAGEVADNAAAKPLITTLLPKMIARINDWFEEVKAKRCKRPTAFQFL QEIKFEAVAYITIKTTLACLTSADNTTVQAVASAIGRAIEDEARFGRIRDLEA KHFKKNVEEQLNKRVCHVYKKAFMQVVEADMLSKGLLGGEAWSSWHKEDSIHV GVRCIEMLIESTGMVSLHRQNACVVCQDSETIELAPEYAEAIATRACALAGIS PMFQPCVVPPKPWTGITGSSGYWANGRRPLALVRTHSKKALMRYEDVYMPEVYK AINIAQNTAWKINKKVLAVANVITKWKHGPVWDIPAIEREELPMKPEDIDMNP EALTAWKRAAAAVYRNDKARKSRRISLEFMLEQANKFANHKAIWFRYNMDERC RVYAVSMFNFQCNDMTKGLLTLAKGKPIGKEGYYWLKIHGANCAGVDKVETFE RIKFIEENHENIMACAKSPLENTWWAEQDSPFCFLAFCFEYAGVQHHCLSYNC SLPLAFDCSCSGIQHFSAMLRDEVGGRAVNLLFSETVQDIYGIVAKKVNEILQ ADAINGTDNEVVTVTDENTGEISEKVKLGTKALAGQWLAYSVTRSVTKRSVMT LAYGSKEFGFRQQVLEDTIQPAIDSGKGLMFTQPNQAAGYMAKLIWESVSVTV VAAVEAMNWLKSAAKLLAAEVKDKKTGEILRKRCAVHWVTDDCFPVWQEYKKD IQTRLNLMFLGQFRLQPTINTNKDSEIDAHKQESGIAPNFVHSQDGSHLRKTV VWAHEKYGIESFALIHDSFGTIPADAANLFKAVRETMVDTYESGDVLADFYDQ FADQLHESQLDKMPALDAKGNLNLRDILESDFAFA | 237 |
| E350W, D653T | MNTINIAKNDFSDIELAAIPFNTLADHYGEKLAREQLALEHESYEMCEARYRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHYKKNVEEQLNKRVGHVYKKAYMQVVEADMLSNGLLCGEAWSSWHKEDSIHV GVRCIEMLIESTGMVSLHRQNAGVVGQDSETIELAPEYAEAIATRAGALAGIS PMFQPCVVPPKPWTGITGSGYWANGRRPLALVRTHSKKALMRYEDVYMPEVYK AINIAQNTAWKINKKVLAVANVITKWKHCPVWDIPAIEREELPMKPEDIDMNP EALTAWKRAAAAVYRKDKARKSRRISLEFMLEQANKFANHKAIWFFYNMDWRG RVYAVSMFNPQGNDMTKGLLTLAKGKPIGKEGYYWLKIHGANCAGVDKVPFFE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYGVTRSVTKRSVMT LAYGSKEFGFRQQVLETTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLCQFRLQPTINTNKDSEIDAHKQESGIAPNFVHSQDGSHLRKTV VWAHEKYGIESFALIHDSFGTIPADAANLFKAVRETMVDIYESGDVLADFYDQ FADQLHESQLDKMPALDAKGNLNLRDILESDFAFA | 238 |
| D351V, K387N | MNTINIAKNDFSDIELAAIFFNTLADHYGERLAREQLALEHESYEMGEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVKCIEMLIESIGMVSLHKQNAGVVGQDSETIELAPEYAEAIAIRAGALAGIS PMFQPCVVPPKPWTGITGGGYWANGRRPLALVRTHSKKALMRYEDVYMPEVYK AINIAQNTAWKINKKVLAVANVITKWKHCPVEVIPAIEREELPMKPEDIDMND EALTAWKRAAAAVYRNDKARKSRRISLEFMLEQANKFANHKAIWYPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVARKVNEILQ ADAINGTDNEVVTVTDENIGEISEKVKLGTKALAGQWLAYGVTRSVTKRSVMT LAYGSKEFGFRQQVLEDTIQPAIDSGKGLMFTQPNQAAGYMAKLIWESVSVTV VAAVEAMNWLKSAAKLLAAEVKDKNTGEILKKRCAVHWVTPDGFPVWQEYKRP IQTRLNLMFLGQFRLQPTINTNKDSEIDAHKQESGIAPNFVHSQDGSHLRKTV VWAHEKYGIESFALIHDSFGTIPADAANLFKAVRETMVDTYESGDVLADFYDQ FADQLHESQLDKMPALPAKGNLNLRDILESDFAFA | 239 |
| D351V, D653T | MNTINIAKNDFSDIELAAIPFNTLADHYGERLAREQLALEHESYEMGEARFRK MFERQLKAGEVADNAAAKPLITTLLPKMIARINDWFEEVKAKRGKRPTAFQFL QEIKDEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELADEYAEAIATRAGALAGIS PMFQPCVVPPKPWTGITGGGYWANGRRDLALVRTHSKKALMRYEDVYMDEVYK AINIAQNTAWKINKKVLAVANVITKWKHCPVEVIPAIEREELPMKPEDIDMND EALTAWKRAAAAVYRKDKARKSRRISLEFMLEQANKFANHKAIWFRYNMDWRG RVYAVSMFNDQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGTKALAGQWLAYSVTRSVTKRSVMT LAYGSKEFGFRQQVLETTIQPAIDSGKGLMFTQPNQAAGYMAKLIWESVSVTV VAAVEAMNWLKSAAKLLAAEVKDKKTGEILRKRCAVHWVTPDGFPVWQEYKKP | 240 |

TABLE 6-continued

Additional Multi-Substitution Variants

| RNA Polymerase Variants | Amino Acid Sequence | SEQ ID NO |
|---|---|---|
| | IQTRLNLMFLGQYRLQPTINTNKDSEIDAHKQESGIAPNYVHSQDGSHLRKTV<br>VWAHEKYGIESFALINDSFGTIPADAANLFKAVRETMVDTYESGDVLADFYDQ<br>FADQLHESQLDKMPALPAKGNLNLRDILESDFAFA | |
| K387N, D653T | MNTINIAKNDFSDIELAAIPFNTLADHYGERLAREQLALEHESYEMGEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRDLALVRTHSKKALMRYEDVYMPEVYK<br>AINIAQNTAWKINKKVLAVANVITKWKHCPVEDIPAIEREELPMKPEDIDMND<br>EALTAWKRAAAAVYRNDKARKSRRISLEFMLEQANKFANHKAIWFDYNMDWRG<br>RVYAVSMFNPQCNDMTKGLLTLAKGKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSEIVQDIYGIVAKKVNEILQ<br>ADAINGTDNEVVTVTDENTGEISEKVKLGIKALAGQWLAYGVTRSVTKRSVMT<br>LAYCSKEFGFRQQVLETTIQPAIESGKOLMFTQPNQAAGYMAKLIWESVSVTV<br>VAAVEAMNWLKSAAKLLAAEVKDEKTGEILRKRCAVHWVTPDGFPVWQEYKKP<br>IQTRLNLMFLGQFRLQPTINTNKDSEIDAHKQESGIAPNFVHSQDGSHLRKTV<br>VWAHEKYGIESFALIHDSFGTIPADAANLFKAVRETMVDTYESGDVLADFYDQ<br>FADQLHESQLDKMPALPAKGNLNLRDILESDFAFA | 241 |
| E350X, D351X | MNTINIAKNDFSDIELAAIPFNTLADHYGERLAREQLALEHESYEMGEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVIMPEVYK<br>AINIAQNTAWKINKKVLAVANVITKWKHCPVXXIPAIEREELPMKPEDIDMNP<br>EALTAWKRAAAAVYRKDKARKSRRISLEMLEQANKFANHKAIWFPYNMDWRG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGIKALAGQWLAYGVTRSVTKRSVMT<br>LAYGSKEFCFRQQVLEDTIQPAIDSCKCLMFTQPNQAACYMAHLIWESVSVTV<br>VAAVEAMNWLKSAAKLLAAFVKDKKTGFILRKRCAVHWVTPDGFPVWQFYKKP<br>IQTRLNLMFLGQFRLQPTINTNKDSEIDAHKQESGIAPNFVHSQDCSHLRKTV<br>VWAHEKYGIESFALIHDSFGTIPADAANLFKAVRETMVDTYESGDVLADFYDQ<br>FADQLHESQLDKMPALPAKGNLNLRDILESDFAFA | 242 |
| E350X, K387X | MNTINIAKNDFSDIELAAIFFNTLADHYGERLAREQLALEHESYEMGEARFRK<br>MFERQLKAGEVADNAAAKPLITILLPKMIARINDWFEEVKAKRGKRPTAFQFL<br>QEIKPEAVAITIIKTTLACLTSADNTTVQAVASAIGRALEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPCVVPPKPWTGITGGGYWANGRRPLALVRTHSKKALMRYEDVYMPEVYK<br>AINIAQNTAWKINKKVLAVANVITKWKHCPVXDIPAIEREELPMKPEDIDMNP<br>EALTAWKRAAAAVYRXDKARKSRRISLEFMLEQANKFANHKAIWFPYNMDWRC<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHCLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKALAGQWLAYSVTRSVTKRSVMT<br>LAYGSKEFGFRQQVLEDTIQPAIDSGKGLMFTQPNQAAGYMAHLIWESVSVTV<br>VAAVEAMNWLKSAAKLLAAEVKDNKTGEILRKRCAVHWVTPDGFPVWQEYKKP<br>IQTRLNLMYLGQYRIQPTINTNKDSEIDAHKQESGIAPNFVHSQDGSHLRKTV<br>VWAHEKYGIESFALIHDSFGTIPADAANLFKAVRETMVDTYESGDVLADFYDQ<br>FADQLHESQLDKMPALDAKGNLNLRDILESDFAFA | 243 |
| E350X, D653X | MNTINIAKNDFSDIELAAIPFNTLADHYGERLAREQLALEHESYEMGEARFRK<br>MFERQLKAGEVADNAAAKPLITTLLPKMIARINDWFEEVKAKRGKRPTAFQFL<br>QEIKPEAVAYITIKTTLACLTSADNTTVQAVASAIGRAIEDEARFGRIRDLEA<br>KHFKKNVEEQLNKRVGHVYKKAFMQVVEADMLSKGLLGGEAWSSWHKEDSIHV<br>GVRCIEMLIESTGMVSLHRQNAGVVGQDSETIELAPEYAEAIATRAGALAGIS<br>PMFQPGVVPPKPWTGITGGGYWANGRRPLALVRTHSKKALMRYEDVYMPEVYK<br>AINIAQNTAWKINKKVLAVANVITKWKHCPVXDIPAIEREELPMKPEDIDMNP<br>EALTAWKRAAAAVYRKDKARKSRRISLEFMLEQANKFANHKAIWFPYNMDERG<br>RVYAVSMFNPQGNDMTKGLLTLAKGKPIGKEGYYWLKIHGANCAGVDKVPFPE<br>RIKFIEENHENIMACAKSPLENTWWAEQDSPFCFLAFCFEYAGVQHHGLSYNC<br>SLPLAFDGSCSGIQHFSAMLRDEVGGRAVNLLPSETVQDIYGIVAKKVNEILQ<br>ADAINGTDNEVVTVTDENTGEISEKVKLGTKATAGQWLAYSVTRSVIKRSVMT | 244 |

TABLE 6-continued

Additional Multi-Substitution Variants

| RNA Polymerase Variants | Amino Acid Sequence | SEQ ID NO |
|---|---|---|
| | LAYGSKEFGFRQQVLEXTIQPAIDSGKGLMFTQPNQAAGYMAKLIWESVSVTV VAAVEAMNWLKSAAKLLAAEVKDKKTGEILRKRCAVHWVTPDGFPVWQEYKKP IQTRLNLMFLGQFRLQPTININKDSEIDAHKQESGIAPNFVHSQDGSHLRKTV VWAHEKYGIESFALIHDSFGTIPADAANLFKAVRETMVDTYESGDVLADFYDQ FADQLHESQLDKMPALPAKGNLNLRDILESDFAFA | |
| D351X, K387X | MNTINIAKNDFSDLELAAIPFNTLADRYGEKLAREQLALEHESYEMGEARYRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHYKKNVEEQLNKRVCHVYKKAYMQVVEADMLSKGLLGGEAWSSWHKEDSIHV GVRCIEMLIESTGMVSLHRQNAGVVGQDSETIELADEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEXIPAIEREELPMKPEDIDMNP EALTAWKRAAAAVYRXDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHGLSYNC SLPLAFDGSCSGIQHFSAMLRDEVGGRAVNLLPSETVQDIYGIVAKKVNEILQ ADAINGTDNEVVTVTDENTGEISEKVKLGGKATACQWLAYGVTRSVGKRSVMP LAYGSKEFGFRQQVLEDTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDGSHLRKTV VWAHENYGIESFALIHDSFGTIPADAANLFKAVRETMVPTYESGDVLADFYDQ FADQLHESQLDKMPALPAKGNLNLRDILESDFAFA | 245 |
| D351X, D653X | MNTINIAKNDFSDIELAAIPFNTLADHYGERLAREQLALEHESYEMGEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIKV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEXIPAIEREELPMKPEDIDMNP EALTAWKRAAAAVYRKDKARKSRRISLEFMLEQANKFANHKAIWFPYNMDWRG RVYAVSMFNPQGNDMTKGLLTLAKGKPIGKEGYYWLKIHGANCAGVDKVPFFE RIKFIEENHENIMACAKSPLENTWWAEQDSPFCFLAFCFEYAGVQHHGLSYNC SLPLAFPGSCSGIQHFSAMLRDEVGGRAVNLLPSETVQDIYGIVAKKVNEILQ ADAINGTDNEVVTVTDENTGEISEKVKLGCKATAGQWLAYGVTRSVCKRSVMP LAYGSKEFGFRQQVLEXTIQPAIDSGKGLMFTQPNQAAGYMAKLIWESVSVTV VAAVEAMNWLKSAAKLLAAEVKDKKIGEILKKRCAVHWVIPDFPPVWQEYKKP IQTRLNLMFLGQFRLQFTINTNKDSEIDAHKQESGIAPNFVHSQDGSHLRKTV VWAHEKYGIESFALIHDSFGTIPADAANLFKAVRETMVDTYESGDVLADFYDQ FADQLHESQLDKMPALPAKGNLNLRDILESDFAFA | 246 |
| K387X, D653X | MNTINIAKNDFSDIELAAIPFNTLADHYGERLAREQLALEHESYEMGEARFRK MFERQLKAGEVADNAAAKPLITTLLPKMIARINDWFEEVKAKRGKRPTAFQFL QEIKPEAVAYITIKTTLACLTSADNTTVQAVASAIGRAIEDEARFGRIRDLEA KHFKKNVEEQLNKRVGHVYKKAFMQVVEADMLSKGLLGGEAWSSWHKEDSIHV GVRCIEMLIESTGMVSLHRQNAGVVGQDSETIELAPEYAEAIATRAGALAGIS PMFQPCVVPPKPWTGITGGGYWANGRRPLALVRTHSKKALMRYEDVYMPEVYK AINIAQNTAWKINKKVLAVANVITKWKHCPVEDIPAIEREELPMKPEDIDMNP EALTAWKRAAAAVYRXDKARKSRRISLEFMLEQANKFANHKAIWFPYNMDWRG RVYAVSMFNPQGNDMTKGLLTLAKGKPIGKEGYYWLKIHGANCAGVDKVPFPE RIKFIEENHENIMACAKSPLENTWWAEQDSPFCFLAFCFEYAGVQHHCLSYNC SLPLAFDGSCSGIQHFSAMLRDEVGGRAVNLLPSETVQDIYGIVAKKVNEILQ ADAINGTDNEVVTVTDENTGEISEKVKLGGKALAGQWLAYSVTRSVCKRSVMT LAYGSKEFGFRQQVLEXTIQPAIDSGKGLMFTQPNQAAGYMAHLIWESVSVTV VAAVEAMNWLKSAAKLLAAEVKDKKTGEILRKRCAVHWVTPDGFPVWQEYKKP IQTRLNLMFLGQFRLQPTINTNKDSEIDAHKQESGIAPNFVHSQDCSHLRKTV VWAHEKYGIESFALIHDSEGTIPADAANLFKAVRETMVDTYESGDVLADFYDQ FADQLHESQLDKMDALFAKGNLNLRDILESDFAFA | 247 |

Example 2. IVT Reactions Using Multi-Substitution+C-Terminal G RNA Polymerase Variants In vitro transcription (IVT) reactions were performed using DNA template, GAG cap analog, and multi-substitution+C-Terminal G RNA polymerase variants, as provided in Table 5. All polymerase variants used in this example included a G47A mutation, a C-Terminal G addition, and one further genetic substitution at position E350, D351, K487, R394, R425, Y427, N437, K441, R632, H811, F880, or G884.

The following RNA polymerase variants generated yields of total RNA in IVT reactions that were 60% to >100% of the total yields in control IVT reactions performed using a control RNA polymerase variant (G47A+C-terminal G): E350R, E350K, E350D, E350Q, E350N, E350T, E350S, E350C, E350G, E350A, E350V, E350L, E350I, E350P, E350Y, E350W, and E350F; D351R, D351K, D351Q, D351T, D351S, D351C, D351V, D351L, D351I, D351M, D351P, D351Y, and D351W; K387R, K387H, K387T, K387S, K387V, K387L, K387I, and K387M; R394K; N437Q, N437T, N437S, N437G, and N437F; F880Y; and 884S and 884A (C-terminal additions) (data not shown).

The following RNA polymerase variants generated RNA with levels of 3' homogeneity in IVT reactions that were equivalent to, or higher than levels of 3' homogeneity in RNA produced in control IVT reactions performed using a control RNA polymerase variant (G47A+C-terminal G): E350N, E350C, E350G, E350Y, E350W, and E350F; D351R, D351S, D351L, D351M, and D351Y; K387R, K387T, K387L, and K387M; R394K; N437R, N437K, N437H, N437T, N437V, N437I, and N437W; R632K and R632T; and 884Q, 884T, and 884P (C-terminal additions) (data not shown).

The following RNA polymerase variants generated RNA with equivalent or higher (up to 20% increase) % capped RNA (percentage of total RNA comprising a GAG cap) relative to RNA produced in control IVT reactions performed using a control RNA polymerase variant (G47A+C-terminal G): E350R, E350K, E350D, E350Q, E350N, E350T, E350S, E350C, E350G, E350A, E350V, E350L, E350I, E350Y, E350W, and E350F; D351R, D351K, D351Q, D351T, D351C, D351V, D351L, D351M, and D351W; K387H, K387E, K387N, K387T, K387S, K387G, K387A, K387Y, K387W, and K387F; N437T, N437I, N437Y, N437W, and N437F; K441R; R632K and R632T; F880Y; and 884Q, 884T, 884S, 884A, and 884P (C-terminal additions) (data not shown).

Example 3. Multi-Substitution+C-Terminal G RNA Polymerase Variants Produce RNA Products with More Desired Characteristics Relative to a Control Polymerase Variant In vitro transcription reactions were performed using DNA template, GAG cap analog (0.75 mM, 2.25 mM, 3.75 mM, and 7.5 mM), and (1) a G47A+C-terminal G RNA polymerase variant (control polymerase variant; G47A+C-terminal G), (2) a G47A/K387S+C-terminal G RNA polymerase variant (K387S), (3) a G47A/K387H+C-terminal G RNA polymerase variant (K387H), (4) a G47A/K387N+C-terminal G RNA polymerase variant (K387N), (5) a G47A/E350K+C-terminal G RNA polymerase variant (E350K), (6) a G47A/E350N+C-terminal G RNA polymerase variant (E350N), (7) a G47A/E350A+C-terminal G RNA polymerase variant (E350A), (8) a G47A/E350W+C-terminal G RNA polymerase variant (E350W), and (9) a G47A/D351V+C-terminal G RNA polymerase variant (D351V). Following IVT reactions, transcribed RNA products from each reaction was characterized to address the quality of said RNA products, including % capping, dsRNA contamination, purity, and 3' homogeneity.

Figure 1A:
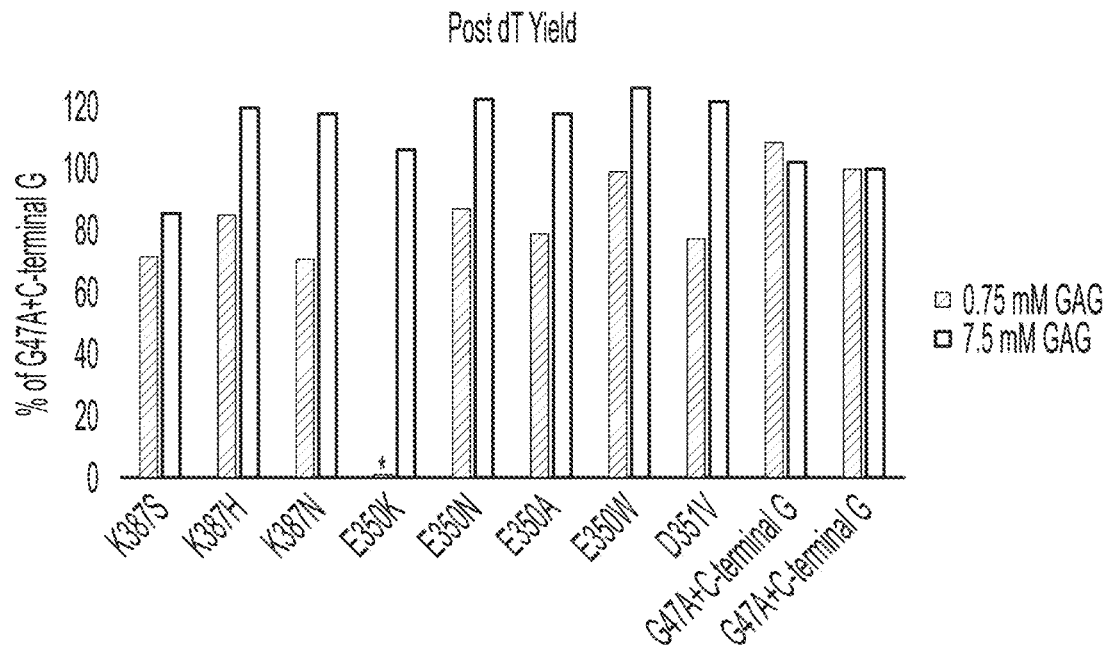
FIGS. 1A-1H show graphs depicting the functional characteristics of transcribed RNA products resulting from in vitro transcription (IVT) reactions involving mutant variants of a control T7 RNA polymerase variant (G47A+C-terminal G) in the presence of varying levels of GAG cap analog. Following an oligo dT purification, transcribed RNA products were analyzed for yield (FIG. 1A), 3' homogeneity (FIG. 1B), amount of dsRNA (FIG. 1C), percent capped RNA (FIG. 1D and FIG. 1E), purity according to a DBAA (dibutylammonium acetate) HPLC method (FIG. 1F), percent tailed (i.e., percent of RNA comprising a polyA tail) according to a Tris RP (reverse-phase) method (FIG. 1G), and indel frequency (FIG. 1H).

The overall yields of total RNA produced using the multi-substitution variants (K387S, K387H, K387N, E350K, E350N, E350A, E350W, and D351V) were comparable to the yield using control RNA polymerase variant, following an oligo dT purification (FIG. 1A). RNA yield was measured by UV absorption.

Figure 1B:
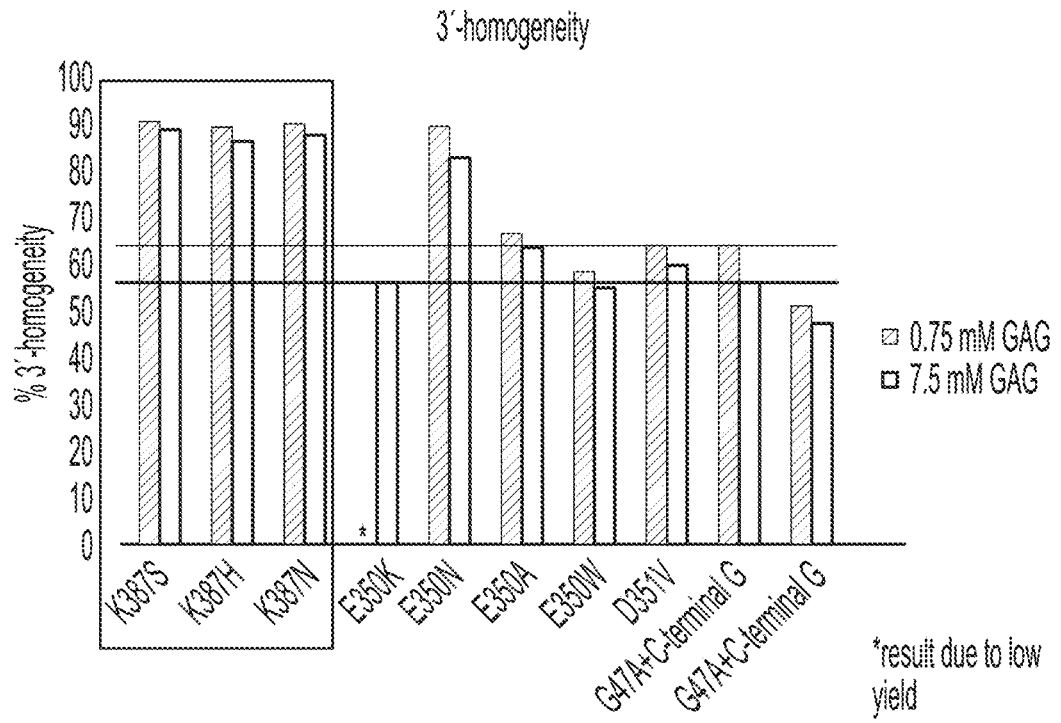

The 3' homogeneity of RNA transcripts were measured using a RNAse T1 digest. RNAse T1 cleaves mRNA specifically after a G nucleotide. Endonucleolytic cleavage results in a 5' hydroxide (OH) and 3' monophosphate (mP) 'scar', while exonucleolytic cleavage results in a clean 5' OH/3' OH cut. Thus, a RNAse T1 digest can be used to differentiate between transcripts that do and do not have non-templated additions at the 3' end. In this Example, RNA produced using the multi-substitution variants had equivalent or higher percent 3' end homogeneity relative to control polymerase variant (FIG. 1B). In particular, as shown in FIG. 1B, K387S, K387H, K387N, and E350N variants produced RNA comprising 3' homogenous ends that was >20 percentage points higher than control variant.

Figure 1C:
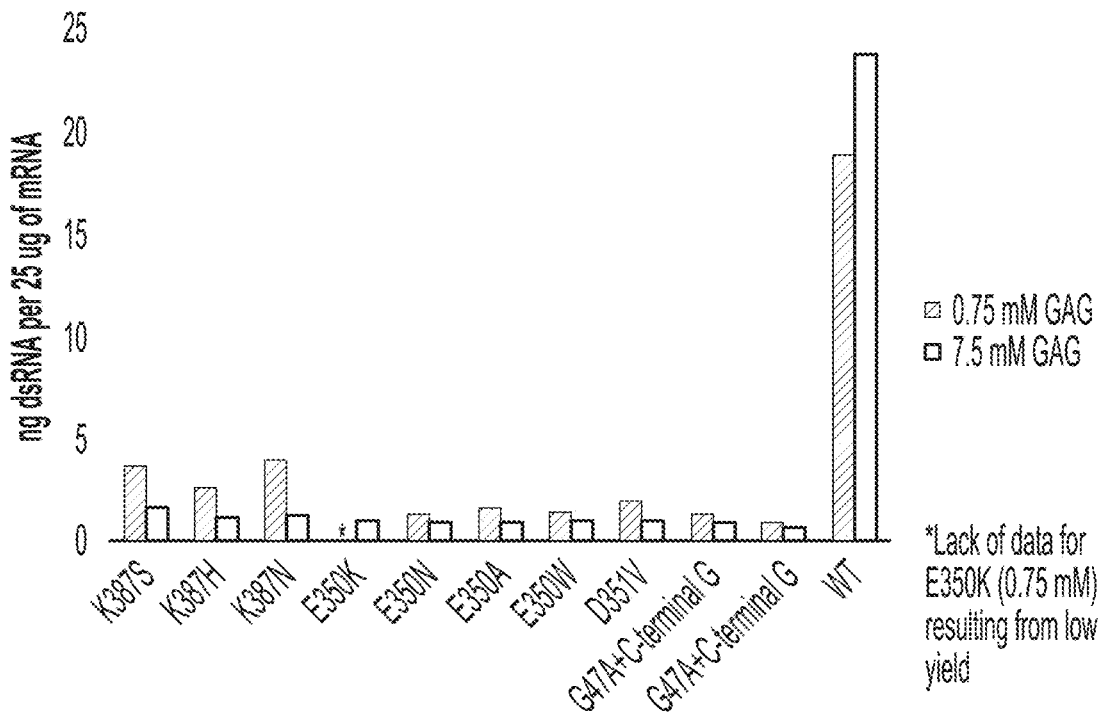
Figure 1C:
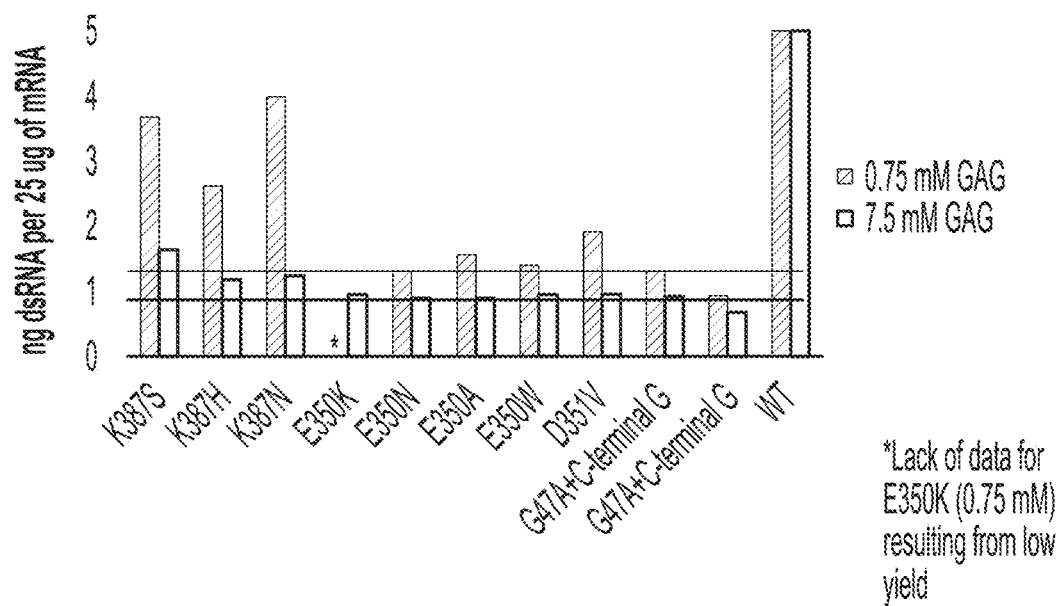

A standard ELISA was used to assess dsRNA contaminants (e.g., dsRNA longer than 40 nucleotide base pairs) following IVT reactions in this Example. All IVT reaction mixtures resulting from multi-substitution variants and the control variant contained less than ~4 ng dsRNA per 25 µg of mRNA (FIG. 1C). Conversely, IVT reaction mixtures resulting from WT T7 polymerase contain ~20 ng dsRNA per 25 µg of mRNA.

Figure 1D:
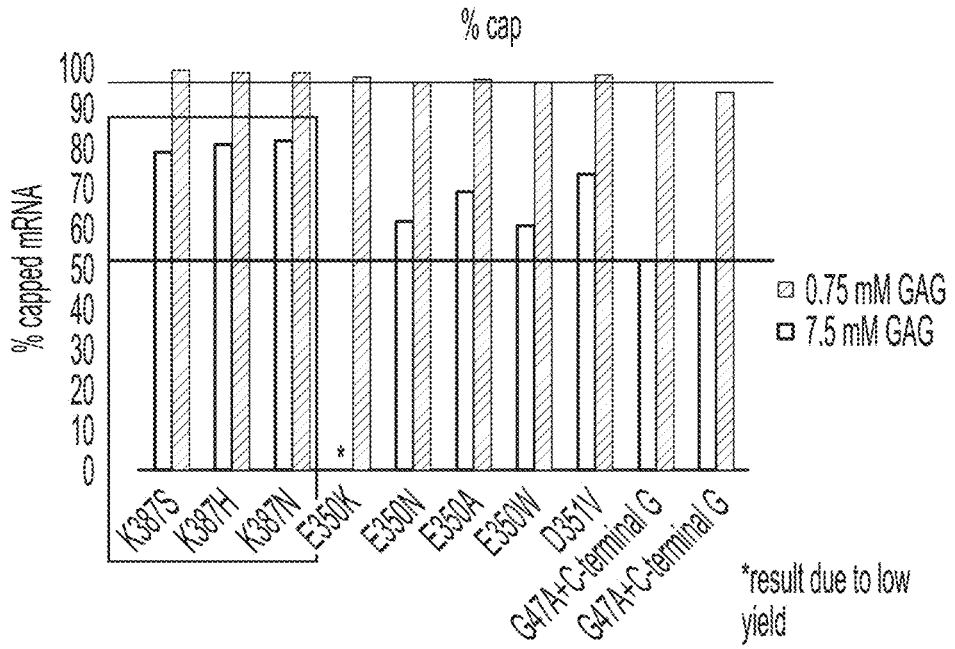
Figure 1E:
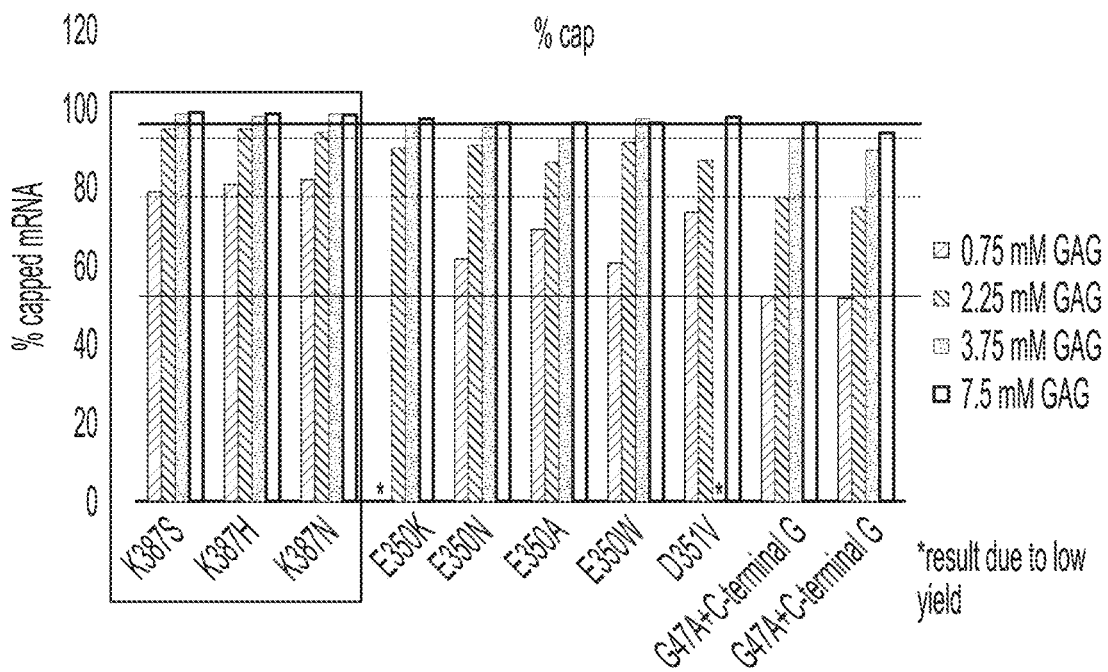

The total RNA products were analyzed by LC-MS to determine % capped RNA (i.e., percent of transcribed RNA comprising a GAG cap). All multi-substitution variants produced RNA with higher levels of % capped RNA relative to control variant (FIGS. 1D-1E) at low and high amounts of GAG cap analog in the starting IVT reaction. In particular, as shown in FIG. 1D-1E, K387S, K387H, K387N, E350A, and D351V variants produced RNA with % capped RNA levels that were 10-25 percentage points higher than control variant, when using 0.75 mM GAG cap analog, the lowest CAP concentration used in this IVT reaction series.

Figure 1F:
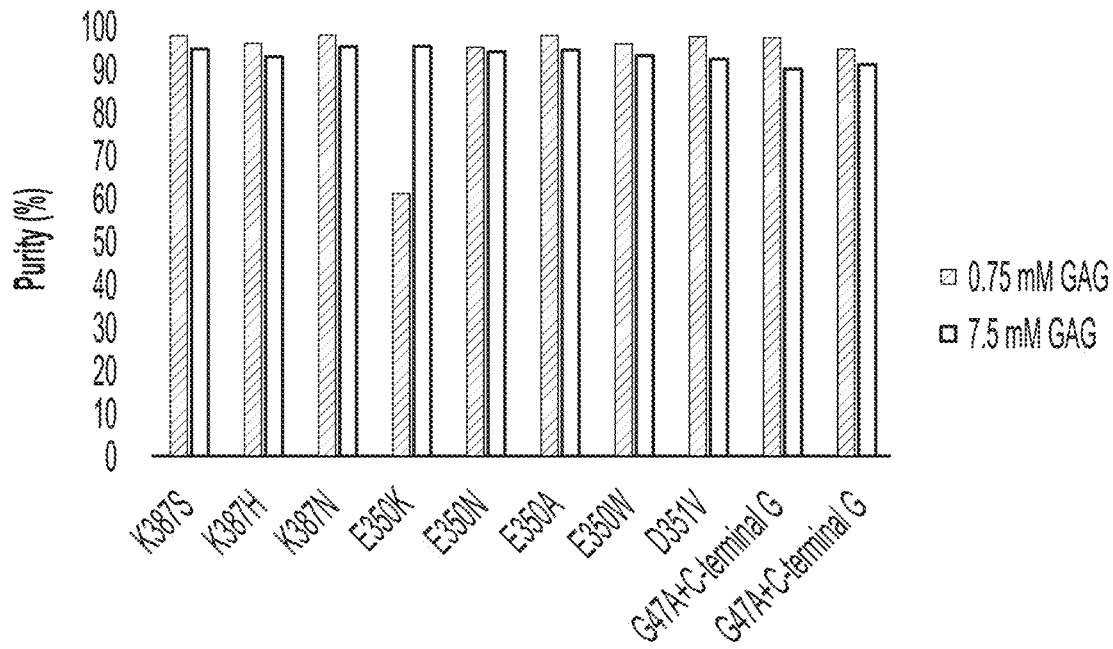

A DBAA (dibutylammonium acetate) HPLC method was used to assess purity of transcribed RNA. Multi-substitution variants produced RNA with comparable purity relative to control variant (>90% purity in most experimental examples) (FIG. 1F)

Figure 1G:
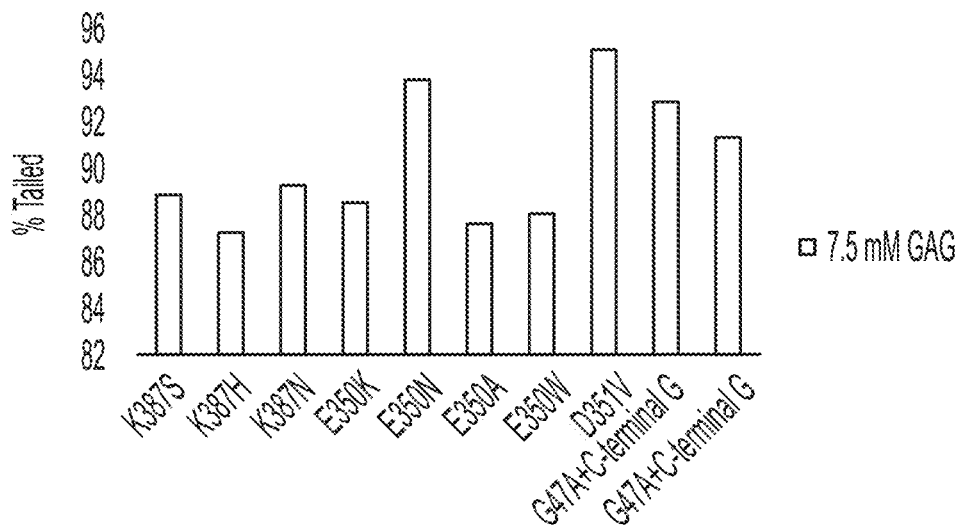

A Tris RP (reverse-phase) method was used to assess percent tailed RNA (i.e., percent of transcribed RNA comprising a polyA tail). Multi-substitution variants produced RNA with comparable % tailing relative to control variant (>85% tailed) (FIG. 1G).

Figure 1H:
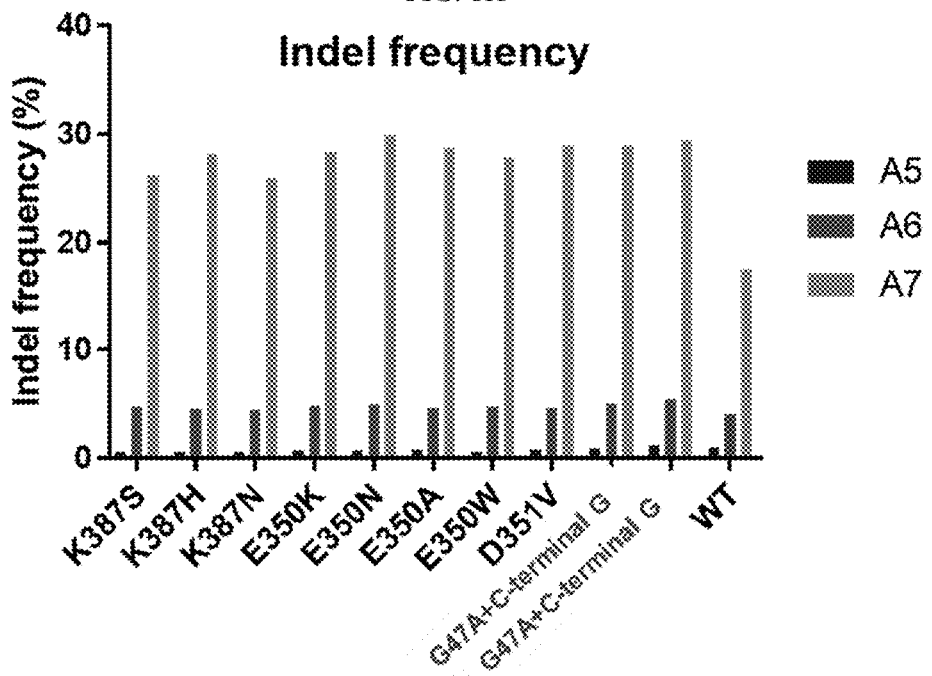

The indel frequencies (insertions/deletion/single point mutations) in transcribed RNA produced by all multi-substitution variants were comparable to indel frequencies produced by control variant polymerase (FIG. 1H). On homopolymeric stretches of >7 A (A7 in FIG. 1H), all variants caused indel frequencies of ~25%, compared to an incidence of ~15% caused by WT polymerase. However, all variants caused marginal indel frequencies in homopolymeric stretches of 5 or 6 A (A5 and A6 in FIG. 1H, respectively), equal to levels caused by WT polymerase.

As demonstrated herein, multi-substitution variants used in this Example produced RNA products in IVT reactions with more desired or improved characteristics relative to a control polymerase variant. Most notably, K387S, K387H, K387N, E350K, E350N, E350A, E350W, and D351V variants showed improved capping efficiency at all tested concentrations of GAG cap analog, relative to control variant.

Figure 2A:
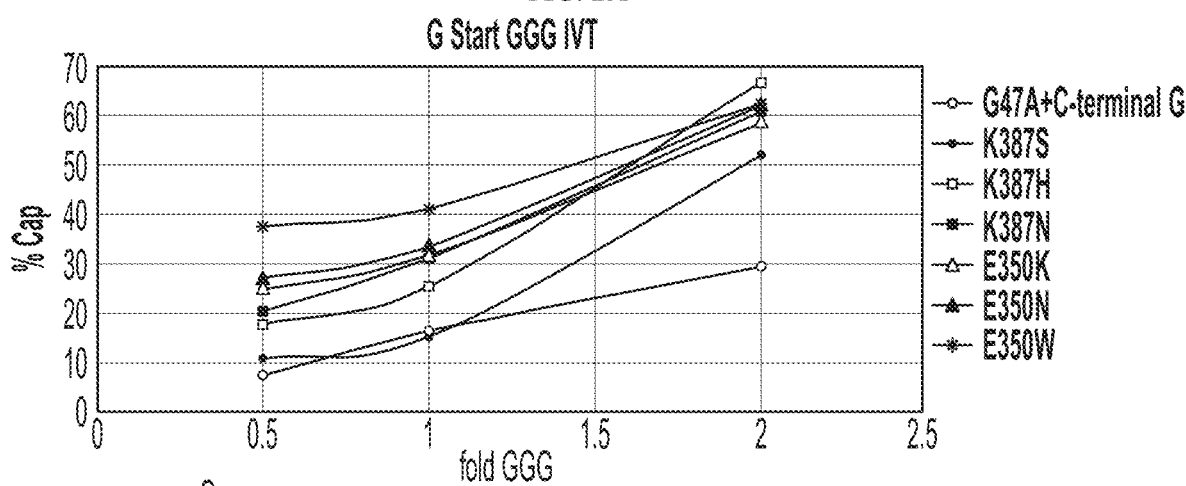
FIGS. 2A-2C show graphs depicting the percent capped RNA resulting from in vitro transcription (IVT) reactions involving mutant variants of a control T7 RNA polymerase variant (G47A+C-terminal G) in the presence of varying levels of GGG cap (FIG. 2A), m6A cap (FIG. 2B), and e6A cap (FIG. 2C).
Figure 2A:
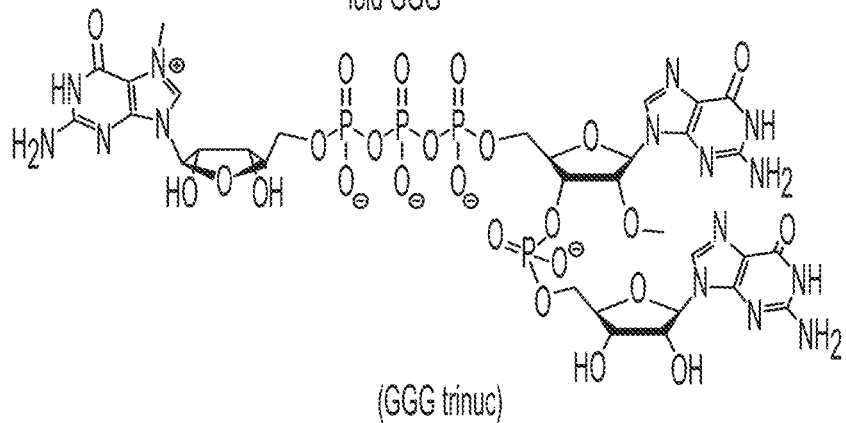
Figure 2B:
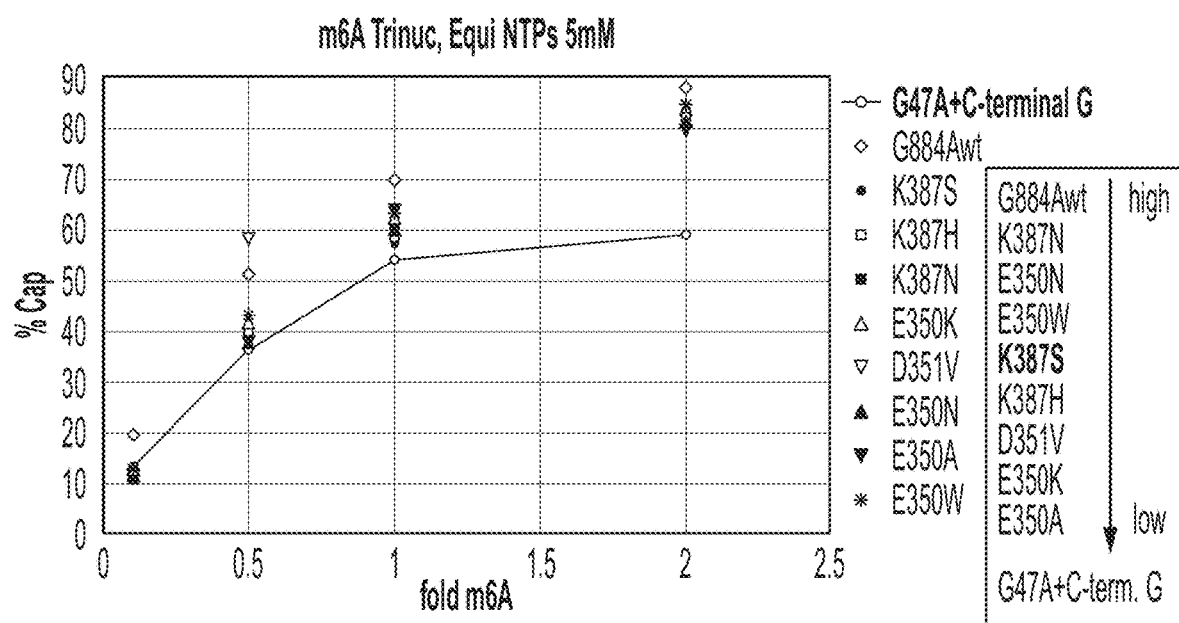
Figure 2B:
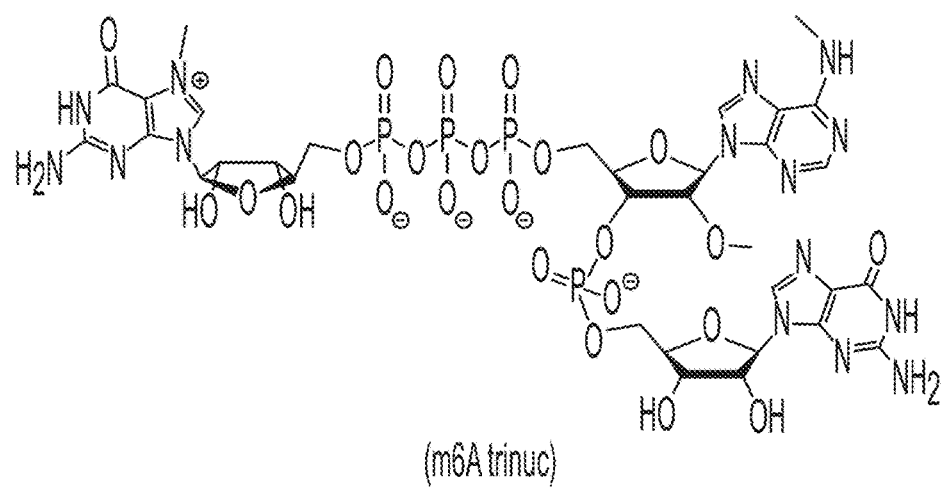
Figure 2C:
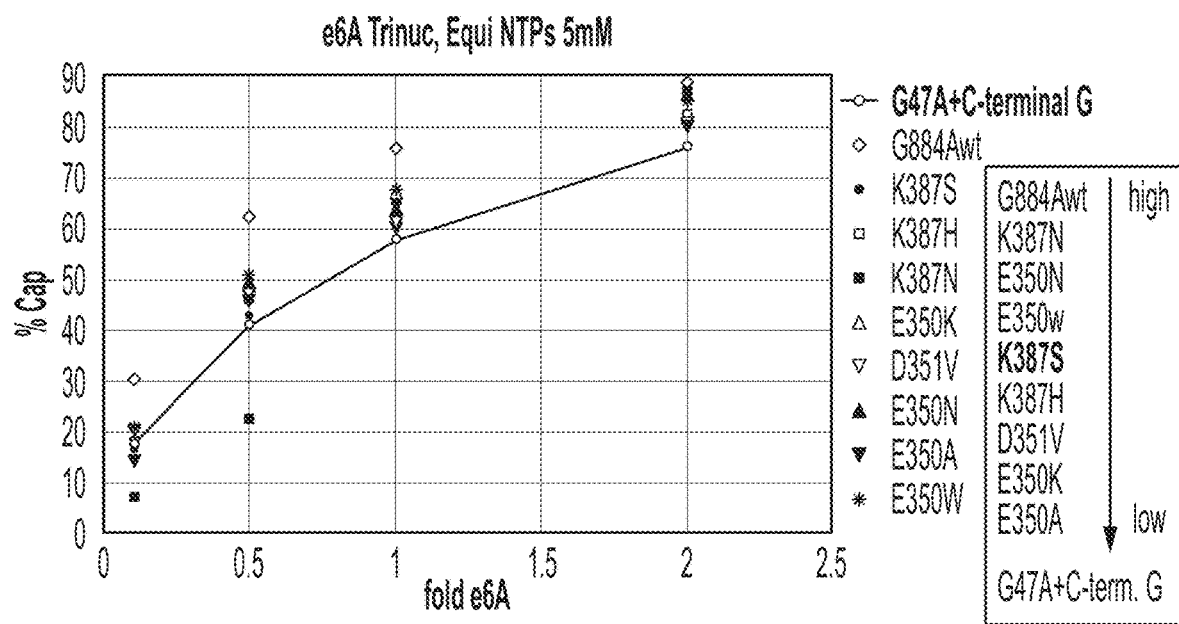
Figure 2C:
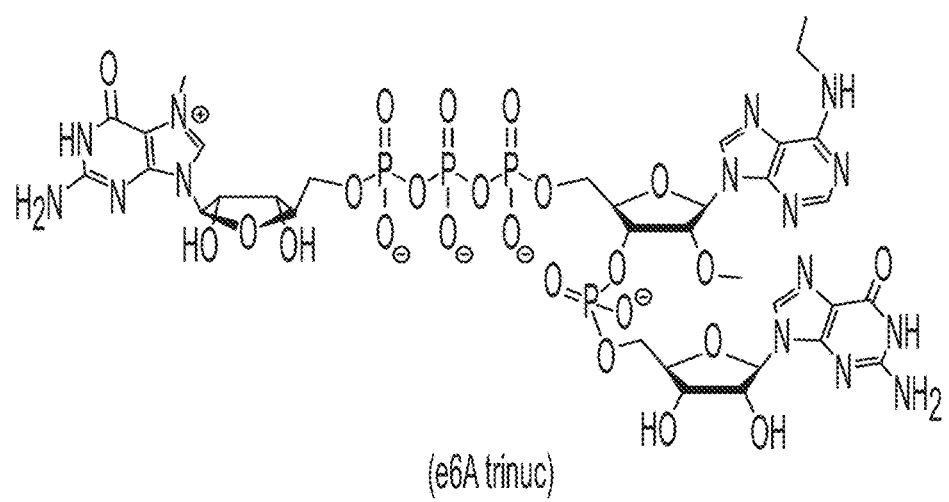

Example 4. Multi-Substitution+C-Terminal G RNA Polymerase Variants Produce RNA Products with Increased Capping Efficiency Relative to a Control Polymerase Variant In vitro transcription reactions were performed using DNA template, one of three cap analogs (GGG cap, Gm6AG cap (referred to as m6A), and Ge6AG (referred to as e6A) cap) at varying concentrations, and (1) a G47A+C-terminal G RNA polymerase variant (control polymerase variant; G47A+C-terminal G), (2) a G47A/K387S+C-terminal G RNA polymerase variant (K387S), (3) a G47A/K387H+C-terminal G RNA polymerase variant (K387H), (4) a G47A/K387N+C-terminal G RNA polymerase variant (K387N), (5) a G47A/E350K+C-terminal G RNA polymerase variant (E350K), (6) a G47A/E350N+C-terminal G RNA polymerase variant (E350N), (7) a G47A/E350A+C-terminal G RNA polymerase variant (E350A), (8) a G47A/E350W+C-terminal G RNA polymerase variant (E350W), (9) a G47A/D351V+C-terminal G RNA polymerase variant (D351V), and (10) G884 RNA polymerase variant (G884 wt). IVT reactions using the GGG cap were initiated using a 5' GTP; IVT reactions using the $m^6A$ and e6A caps were initiated using a 5' ATP (FIG. 2A-2C). Following the IVT reactions, each experiment was subjected to LC-MS to determine the % capped RNA (i.e., percent of transcribed RNA comprising a cap).

All tested multi-substitution variants (K387S, K387H, K387N, E350K, E350N, and E350W) produced significantly higher levels of capped RNA when incorporating GGG cap analog during an IVT reaction, relative to control variant (FIG. 2A), at all tested concentrations of GGG cap analog. Multi-substitution variants produced 50-65% capped RNA in experiments using 2-fold concentrations of GGG cap. The control variant produced only 30% capped RNA in experiments using 2-fold concentrations of GGG cap.

All tested multi-substitution variants (K387S, K387H, K387N, E350K, E350N, E350A, E350W, and D351V) produced significantly higher levels of capped RNA when incorporating m6A cap analog during an IVT reaction, relative to control variant (FIG. 2B), at low (0.5-fold conc. m6A) and high (2-fold conc. m6A) concentrations of m6A cap analog. Multi-substitution variants produced 80-85% capped RNA in experiments using 2-fold concentrations of m6A cap. The control variant produced only 60% capped RNA in experiments using 2-fold concentrations of m6A cap. G884 variant also produced higher levels of % capped RNA than control, with >85% capped RNA in experiments using 2-fold concentration of m6A cap.

Tested multi-substitution variants (K387S, K387H, K387N, E350K, E350N, E350A, E350W, and D351V) produced higher levels of capped RNA when incorporating e6A cap analog during an IVT reaction, relative to control variant (FIG. 2C), at low (0.5-fold conc. e6A) and high (2-fold conc. e6A) concentrations of e6A cap analog. Multi-substitution variants produced 80-88% capped RNA in experiments using 2-fold concentrations of e6A cap. The control variant produced ~75% capped RNA in experiments using 2-fold concentrations of e6A cap. G884 variant also produced higher levels of % capped RNA than control, with ~90% capped RNA in experiments using 2-fold concentration of e6A cap.

As demonstrated herein, multi-substitution+C-Terminal G RNA polymerase variants, such as K387S, K387H, K387N, E350K, E350N, E350A, E350W, and D351V produce transcribed RNA products with increased capping efficiency relative to a control polymerase variant when incorporating a variety of different cap analogs.

Example 5. Multi-Substitution+C-Terminal G RNA Polymerase Variants Produce RNA Products with More Desired Characteristics Relative to a Control Polymerase Variant In vitro transcription reactions were performed using DNA template, GAG cap analog (0.75 mM and 7.5 mM), and (1) a wild-type (WT) RNA polymerase (2) a G47A+C-terminal G RNA polymerase variant (control polymerase variant; G47A+C-terminal G), (3) a G47A/D506W+C-terminal G RNA polymerase variant (D506W), (4) a G47A/S628W+C-terminal G RNA polymerase variant (S628W), (5) a G47A/D653W+C-terminal G RNA polymerase variant (D653W), and (6) a G47A/P657W+C-terminal G RNA polymerase variant (P657W). Following IVT reactions, transcribed RNA products from each reaction was characterized to address the quality of said RNA products, including % capping, dsRNA contamination, purity, and 3' homogeneity.

The overall yields, based on concentration in ng/μL, of total RNA produced using the S628W multi-substitution variant was comparable to the yield using control RNA polymerase variant, following an oligo dT purification (FIG. 3A). Yield of total RNA produced using the D506W, D653W, and P657W multi-substitution variants were lower than the yield using control RNA polymerase variant, although remained at viable yields for downstream experimentation and continued use of said multi-substitution variants. RNA yield was measured by UV absorption.

A Tris RP (reverse-phase) method was used to assess percent tailed RNA (i.e., percent of transcribed RNA comprising a polyA tail). Multi-substitution variants produced RNA with comparable % tailing relative to control variant and WT polymerase (≥90% tailed) (FIG. 3B).

A DBAA (dibutylammonium acetate) HPLC method was used to assess purity of transcribed RNA. Multi-substitution variants produced RNA with comparable purity relative to control variant and WT polymerase (≥85% purity) (FIG. 3C).

The 3' homogeneity of RNA transcripts were measured using a RNAse T1 digest. RNAse T1 cleaves mRNA specifically after a G nucleotide. Endonucleolytic cleavage results in a 5' hydroxide (OH) and 3' monophosphate (mP) 'scar', while transcription terminates in 3' hydroxide (OH). Since the last templated nucleotide is a G, a RNAse T1 digest can be used to differentiate between transcripts that do and do not have non-templated additions at the 3' end. In this Example, RNA produced using the multi-substitution variants had equivalent or higher percent 3' end homogeneity relative to control polymerase variant (FIG. 3D). In particular, D506W, D653W, and P657W variants produced RNA comprising 3' homogenous ends that was significantly higher than control variant.

A standard dsRNA ELISA was used to assess dsRNA contaminants (e.g., longer than 40 nucleotide base pairs) following IVT reactions in this Example. All IVT reaction mixtures resulting from multi-substitution variants and the control variant contained less than −5 ng dsRNA per 25 μg of mRNA (FIG. 3E). Conversely, IVT reaction mixtures resulting from WT T7 polymerase contain more than ~20 ng dsRNA per 25 μg of mRNA.

As demonstrated herein, multi-substitution variants, such as D506W, D653W, and P657W, used in this Example produced RNA products in IVT reactions with comparable or improved characteristics relative to a control polymerase variant.

Example 6. Multi-Substitution+C-Terminal G RNA Polymerase Variants Produce RNA Products with Increased Capping Efficiency Relative to a Control Polymerase Variant In vitro transcription reactions were performed using DNA template, one of three cap analogs (GAG cap, m6A cap, and e6A cap) at varying concentrations, and (1) a G47A+C-terminal G RNA polymerase variant (control polymerase variant; G47A+C-terminal G), (2) a G47A/D506W+C-terminal G RNA polymerase variant (D506W), (3) a G47A/S628W+C-terminal G RNA polymerase variant (S628W), (4) a G47A/D653W+C-terminal G RNA polymerase variant (D653W), and (5) a G47A/P657W+C-terminal G RNA polymerase variant (P657W). IVT reactions using the m6A and e6A cap analogs were incorporated using a DNA template that encodes for a 5'A followed by G. Following the IVT reactions, each experiment was subjected to LC-MS to determine the % capped RNA (i.e., percent of transcribed RNA comprising a cap).

Figure 4A:
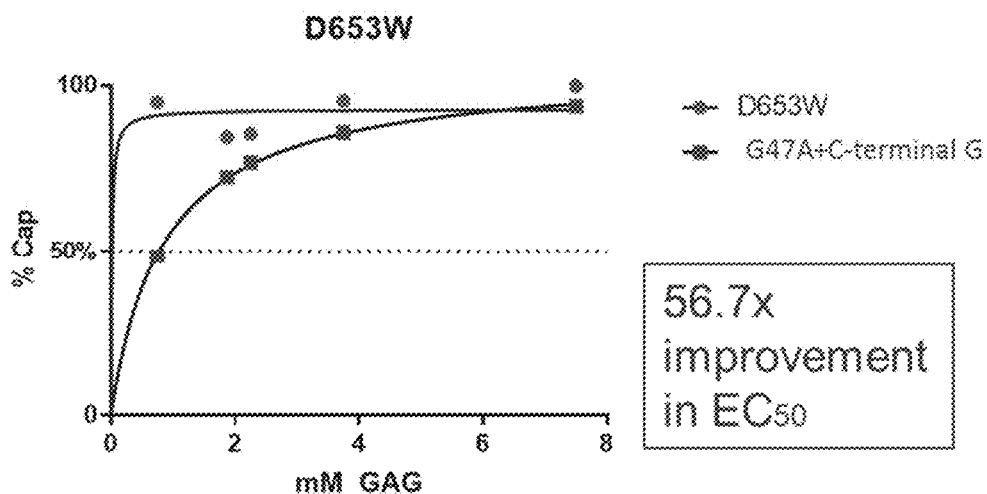
Figure 4B:
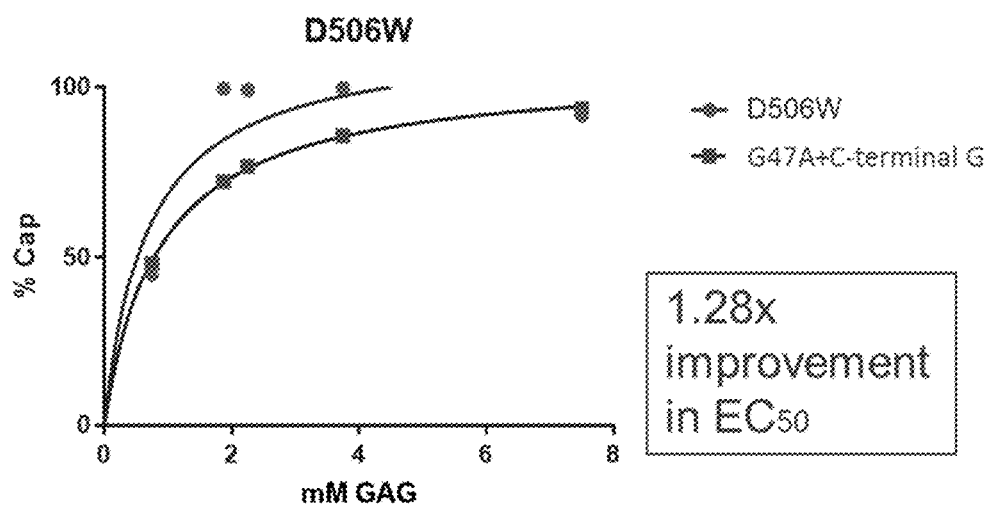
Figure 4C:
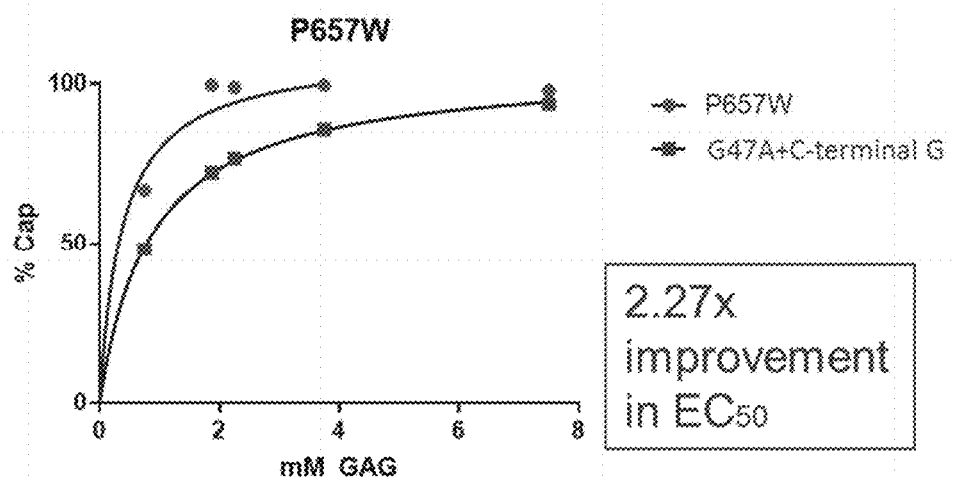
Figure 4D:
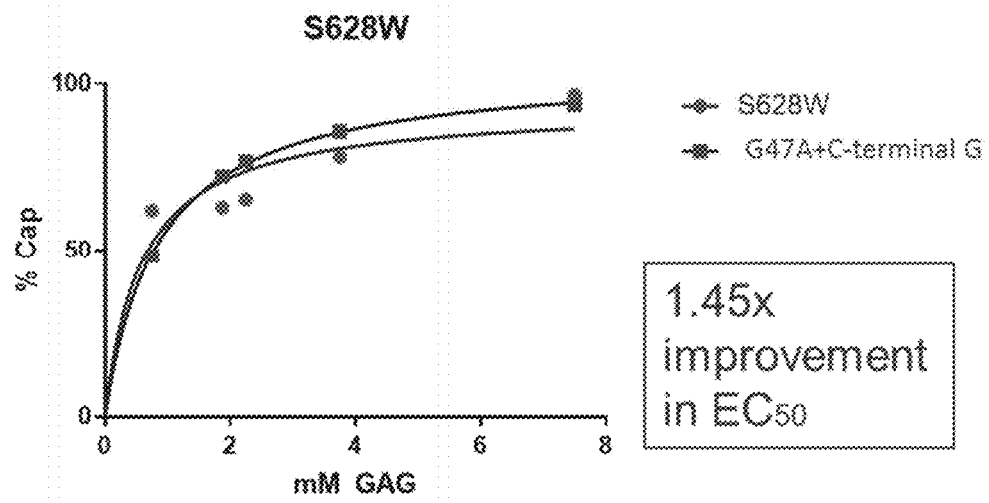
Figure 4E:
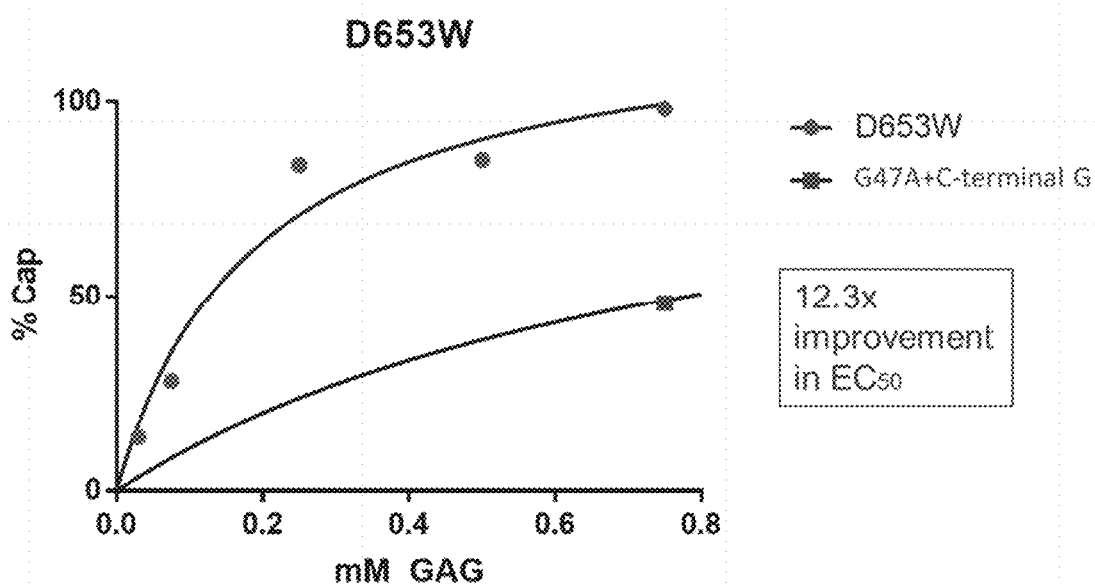
Figure 5A:
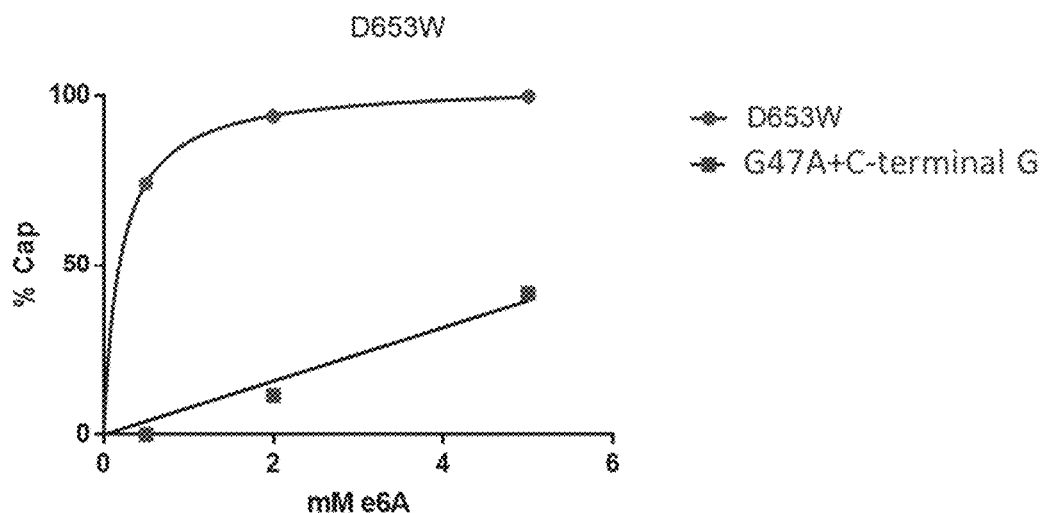
Figure 5B:
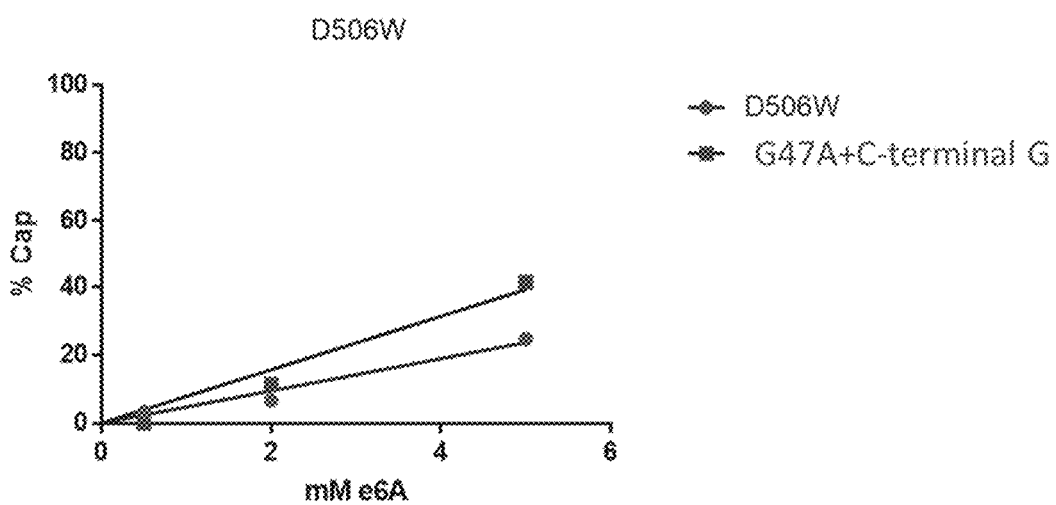
Figure 5C:
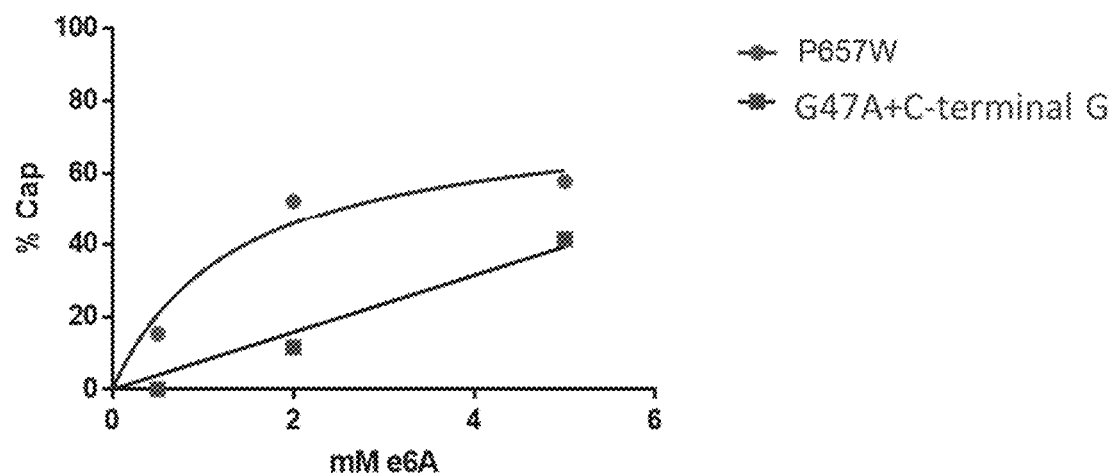
Figure 5D:
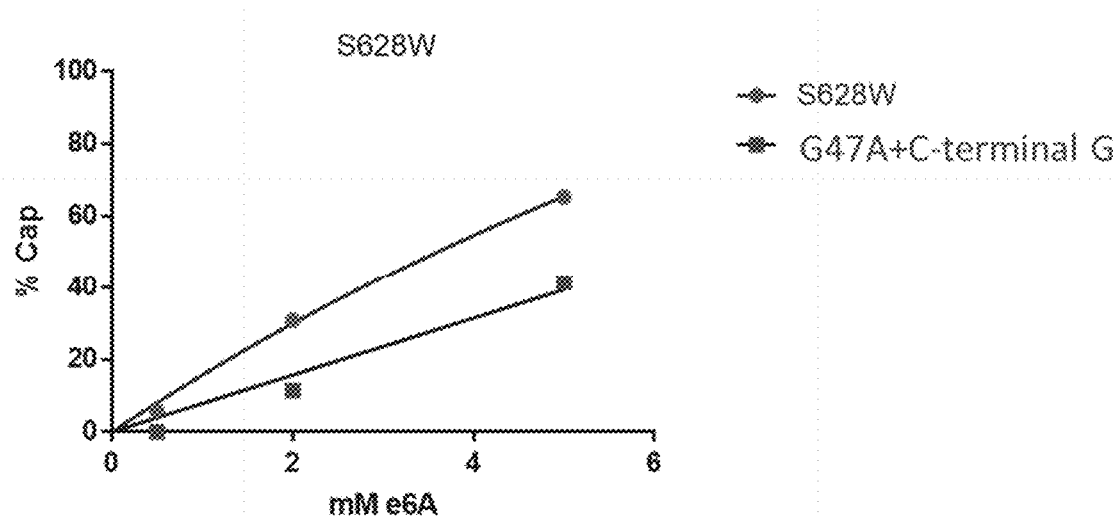
Figure 6A:
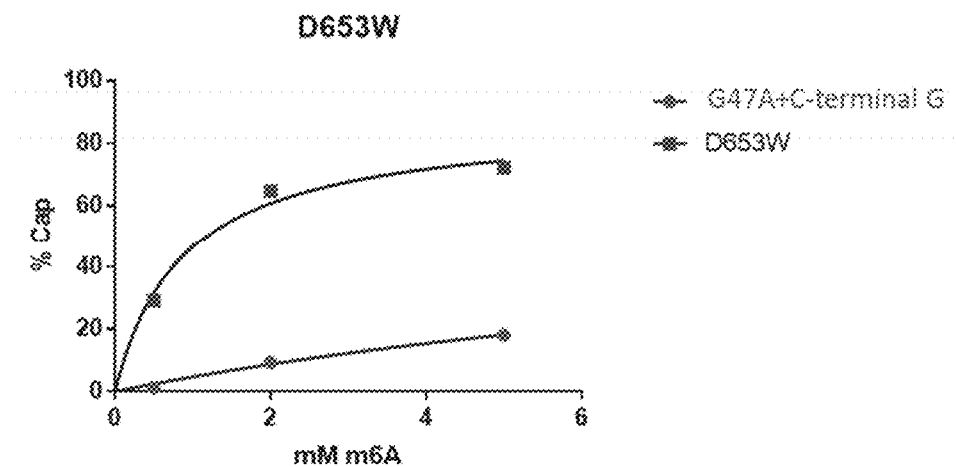
Figure 6B:
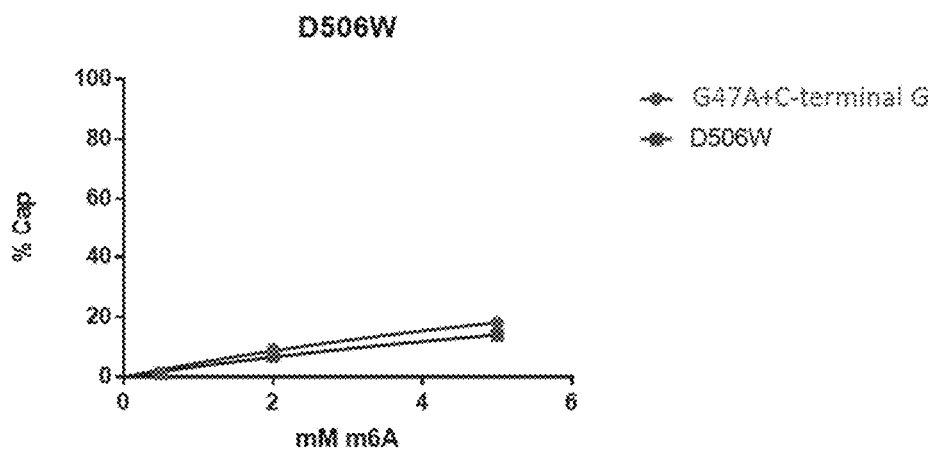
Figure 6C:
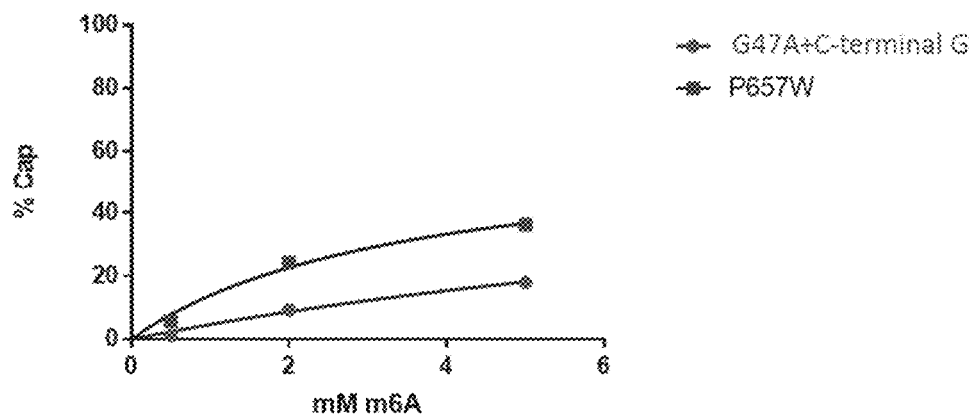
Figure 6D:
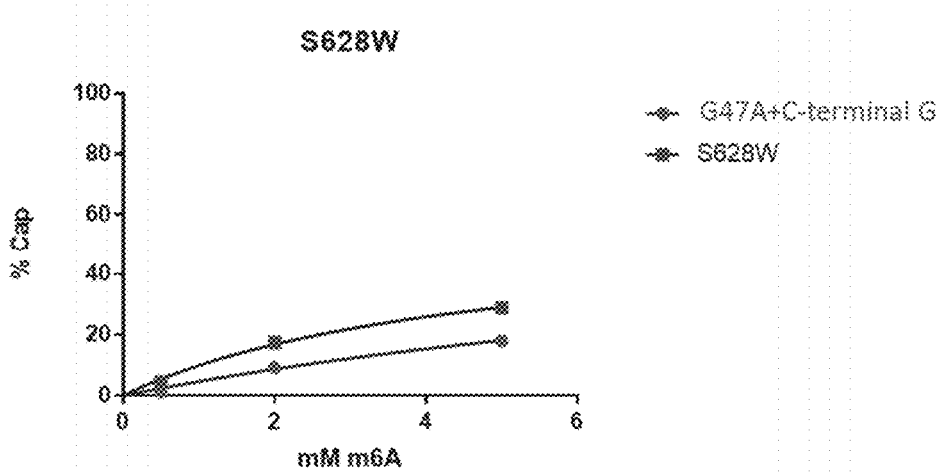

All tested multi-substitution variants (D653W, D506W, P657W, S628W) required lesser effective concentrations of GAG cap analog in order to produce RNA with 50% cap incorporation ($EC_{50}$), relative to control variant, in IVT reactions involving 5 mM of each NTP (FIGS. 4A-4D). Most notably, D653W provided a significant improvement in $EC_{50}$ for GAG cap incorporation, relative to the control variant, with nearly 100% of total RNA incorporating GAG cap at concentrations of GAG as low as 0.75 mM. D506W, P657W, and S628W provided 1.28-, 2.27-, and 1.45-fold improvements (reductions) in $EC_{50}$ for GAG cap incorporation, relative to the control variant. D653W also significantly outperformed the control variant in IVT reactions involving 7.5 mM of each NTP, with a 12.3-fold improvement (reduction) in $EC_{50}$ for GAG cap incorporation, relative to the control variant (FIG. 4E).

All tested multi-substitution variants (D653W, D506W, P657W, S628W) required lesser effective concentrations of e6A cap analog in order to produce RNA with cap incorporation, relative to control variant, in IVT reactions involving 5 mM of each NTP (FIGS. 5A-5D). Most notably, D653W provided nearly 100% of total RNA with incorporated e6A cap at 2 mM e6A. Conversely, even at 5 mM e6A, the control variant provided ~40% of total RNA with incorporated e6A.

All tested multi-substitution variants (D653W, D506W, P657W, S628W) required lesser effective concentrations of m6A cap analog in order to produce RNA with cap incorporation, relative to control variant, in IVT reactions involving 5 mM of each NTP (FIGS. 6A-6D). Most notably, D653W provided nearly 100% of total RNA with incorporated m6A cap at 5 mM m6A. Conversely, even at 5 mM m6A, the control variant provided less than 30% of total RNA with incorporated m6A.

The D653W multi-substitution variant required lesser effective concentrations of GGAG tetranuc cap analog in order to produce RNA with cap incorporation, relative to control variant, in IVT reactions involving 7.5 mM of each NTP (FIG. 7). Most notably D653W provided nearly 100% of total RNA with incorporated GGAG cap at 7.5 mM GGAG tetranuc. Conversely, even at 7.5 mM GGAG tetranuc, the control variant provided less than 70% of total RNA with incorporated GGAG.

As demonstrated herein, multi-substitution+C-Terminal G RNA polymerase variants, such as D653W, D506W, P657W, and S628W produce transcribed RNA products with increased capping efficiency relative to a control polymerase variant when incorporating a variety of different cap analogs (e.g., GAG, e6A, m6A, GGAG tetranuc).

Example 7. Multi-Substitution+C-Terminal G RNA Polymerase Variants Produce RNA Products with Increased Capping Efficiency and RNA Yield Relative to a Control Polymerase In vitro transcription reactions were performed using DNA template, 5 mM equimolar NTPs, 5 mM cap analog (GAG trinuc, e6A trinuc, m6A trinuc, or GGAG tetranuc), and 500 nM T7 RNA polymerase—(1) a G47A+C-terminal G RNA polymerase variant (control polymerase variant; G47A+C-terminal G); (2) a G47A/D653W+C-terminal G RNA polymerase variant (D653W); (3) a G47A/G884P+C-terminal G RNA polymerase variant (G884P); (4) a G47A/G884T+C-terminal G RNA polymerase variant (G884T); (5) a G47A/G884A+C-terminal G RNA polymerase variant (G884A); (6) a G47A/F880Y+C-terminal G RNA polymerase variant (F880Y); (7) a G47A/N437F+C-terminal G RNA polymerase variant (N437F); (8) a G47A/K387N+C-terminal G RNA polymerase variant (K387N); or (9) a G47A/E350N+C-terminal G RNA polymerase variant (E350N).

Following the IVT reaction, mRNA products were oligo-dT purified before being analyzed by LC-MS to determine the % capped RNA (i.e., percent of transcribed RNA comprising a cap) and by HPLC to determine the RNA yield of the reaction.

All tested multi-substitution variants (D653W, G884P, G884T, G884A, F880Y, N437F, K387N, E350N) produced RNA with percent capped RNA at comparable or higher levels than the control polymerase variant in the presence of any one of GAG trinuc, e6A trinuc, m6A trinuc, or GGAG tetranuc (FIGS. 8A-8I). Notably, D653W provided a significant increase in percent capped RNA relative to the control polymerase variant or WT polymerase, particularly in the presence of m6A trinuc (~85% capped) and e6A trinuc (~90% capped). See FIGS. 8B and 8C.

All tested multi-substitution variants (D653W, G884P, G884T, G884A, F880Y, N437F, K387N, E350N) produced higher or comparable yields of total RNA than the control polymerase variant in the presence of GAG trinuc (FIGS. 8E-8I). G884A, F880Y, K387N, and E350N variants produced higher or comparable yields of total RNA than the control polymerase variant in the presence of m6A trinuc.

All tested multi-substitution variants (D653W, G884P, G884T, G884A, F880Y, N437F, K387N, E350N) produced higher yields of percent capped RNA than the control polymerase variant in the presence of GAG trinuc (FIGS. 8A-8D). G884A, F880Y, K387N, and E350N variants produced higher yields of percent capped RNA than the control polymerase variant in the presence of m6A trinuc. F880Y produced higher yields of percent capped RNA than the control polymerase variant in the presence of e6A trinuc.

IVT reactions of the Example were then further analyzed for double-stranded RNA (dsRNA) content, an undesired by-product of IVT reactions, and compared to additional IVT reactions (FIGS. 9A-9D). Notably, none of the tested multi-substitution variants (D653W, G884P, G884T, G884A, F880Y, N437F, K387N, E350N) generated more than ~0.75 ng of dsRNA per 2 µg of total RNA in IVT reactions. This is in contrast to WT T7 polymerase which generates 2-5 ng dsRNA of dsRNA per 2 µg of total RNA in IVT reactions in presence of all tested trinuc and tetranuc cap analogs.

Example 8. G47A/D653W+C-Terminal G RNA Polymerase Produces RNA Products with Increased 3' Homogeneity and Capping Efficiency Relative to Related Singly and Doubly Mutated RNA Polymerases In vitro transcription reactions were performed using DNA template, 5 mM equimolar NTPs, 0.5 mM GAG trinuc, and a T7 RNA polymerase—(1) WT RNA polymerase, (2) G47A RNA polymerase variant, (3) G884A RNA polymerase variant, (4) D653W RNA polymerase variant, (5) G47A/D653W RNA polymerase variant; (6) D653W+C-terminal G RNA polymerase variant; (7) G47A/D653W+C-terminal G RNA polymerase variant; or (8) G47A+C-terminal G RNA polymerase variant.

Figure 10A:
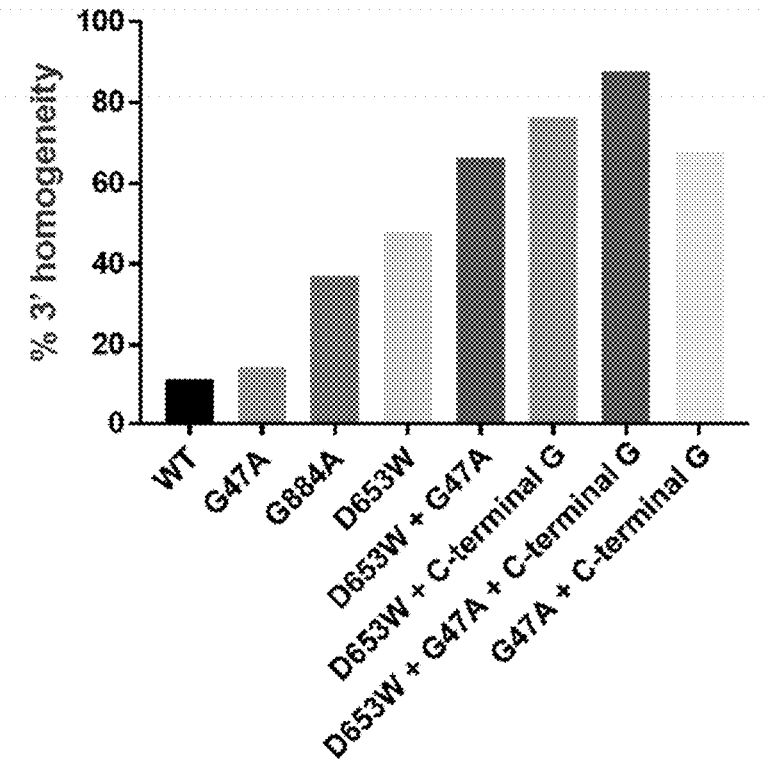
Figure 10B:
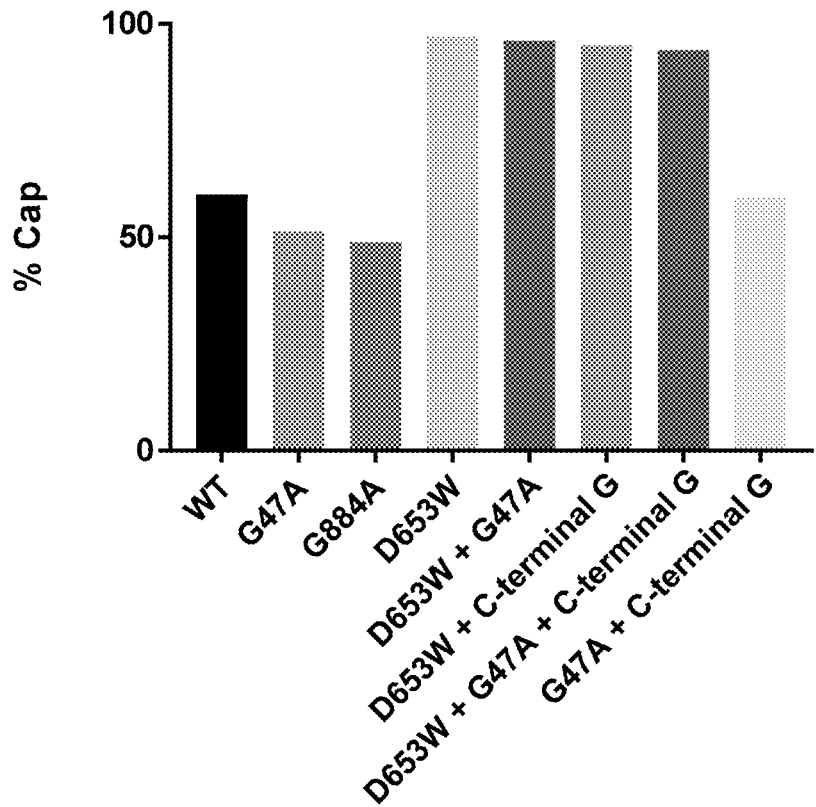
Figure 10C:
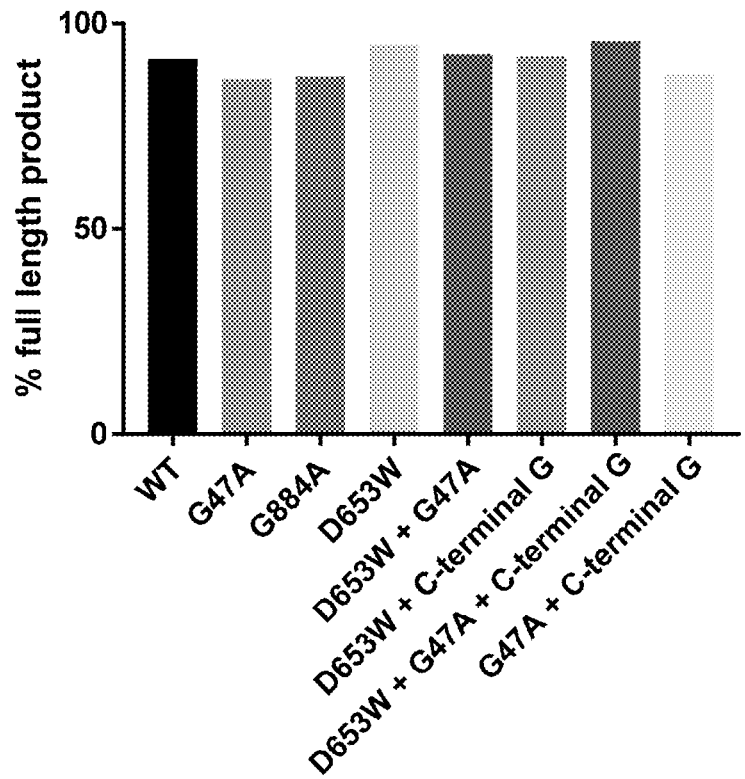
Figure 10D:
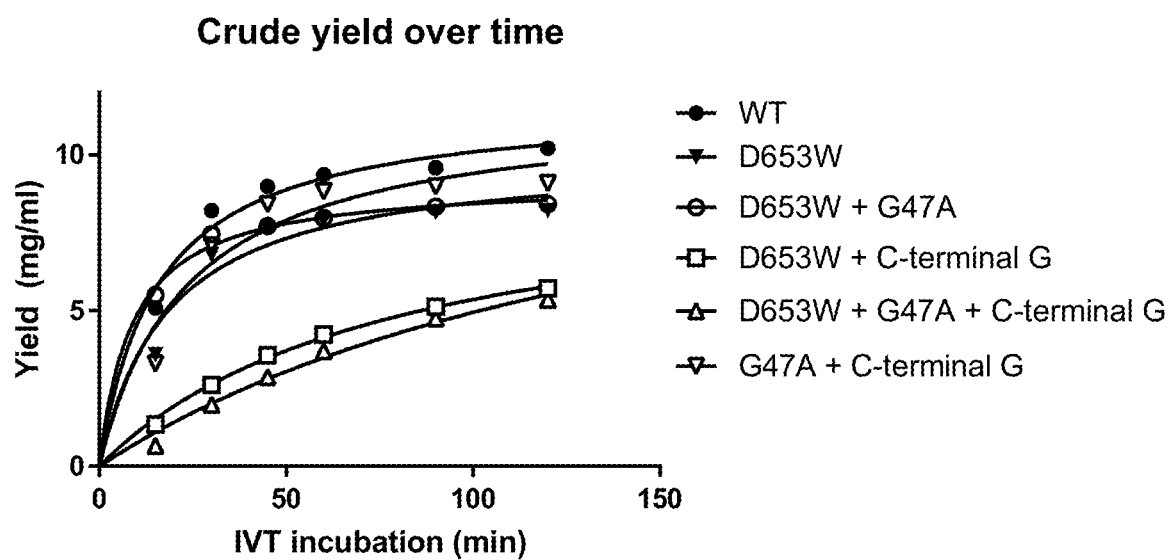

Samples of IVT reactions were collected throughout the length of each reaction (120 min) and analyzed for crude RNA yield over time (FIG. 10D). Following the IVT reaction, mRNA products were oligo-dT purified before being analyzed for 3' homogeneity (FIG. 10A), % capped RNA (i.e., percent of transcribed RNA comprising a cap) (FIG. 10B) and percent full length product (i.e., percent of total RNA comprising full length transcript) (FIG. 10C).

The G47A/D653W+C-terminal G RNA polymerase performed best among tested polymerases, with the D653W+C-terminal G RNA polymerase and G47A+C-terminal G RNA polymerase also providing RNA of excellent quality and yield. The G47A/D653W+C-terminal G RNA polymerase produced RNA wherein ~90% of total RNA comprised 3' homogeneity; the D653W+C-terminal G RNA polymerase produced RNA wherein ~75% of total RNA comprised 3' homogeneity; and the G47A+C-terminal G RNA produced RNA wherein ~70% of total RNA comprised 3' homogeneity. For comparison, WT polymerase produced RNA wherein only ~10% of total RNA comprised 3' homogeneity. All tested polymerases comprising the D653W mutation produced 90-95% capped RNA. Comparatively, WT polymerase only produced ~60% capped RNA in these experiments. All mutant variants of RNA polymerase produced good (>85%) levels of percent full length product. Further, as demonstrated in FIG. 10D, mutant variants of RNA polymerase were able to maintain acceptable RNA yields (5-9 mg/mL at 120 min of reaction time) in these experiments, even while producing RNA of higher quality (higher 3' homogeneity and higher percent capped RNA) than WT polymerase.

Example 9. A D653W+G47A RNA Polymerase Variant Produces RNA Products with Increased Capping Efficiency Relative to a Control Polymerase Variant In vitro transcription reactions were performed using DNA template, one of four cap analogs (GGAG cap, Gm6AAG, Gm6AG cap, or Ge6AG cap) at varying concentrations (1-7 mM cap analog), and either a G47A+C-terminal G RNA polymerase variant (control polymerase variant) or a G47A+D653W RNA polymerase variant. Following the IVT reactions, each experiment was subjected to LC-MS to determine the % capped RNA (i.e., percent of transcribed RNA comprising a cap).

The G47A+D653W RNA polymerase variant produced RNA with higher percent incorporated cap analog for all four test cap analogs, across all concentrations of cap analog, relative to the control polymerase variant (FIG. 11).

Example 10. A Panel of Multi-Substitution RNA Polymerase Variants Produce RNA Products with Increased Capping Efficiency Relative to a Control Polymerase Variant Individual in vitro transcription reactions were performed using DNA template, 5 mM equimolar NTPs, 0.5 mM GAG trinuc, and one of the T7 RNA polymerase variants as shown in Table 7.

Following the IVT reaction, mRNA products were oligo-dT purified before being analyzed by LC-MS to determine the % capped RNA (i.e., percent of transcribed RNA comprising a cap) and by HPLC to determine the RNA yield of the reaction.

TABLE 7

RNA polymerase variant used in Example 9

| RNA Polymerase variant | RNA Yield normalized to G47A + C-terminal G |
| --- | --- |
| D653T + G884S + G47A | 1.31 |
| WT | 1.28 |
| G884S + K387N + G47A | 1.20 |
| D351V + E350N + G47A + C-terminal G | 1.16 |
| G884T + G47A | 1.12 |
| E350A + G47A + C-terminal G | 1.11 |
| D351V + E350W + G47A + C-terminal G | 1.09 |
| K387H + G47A + C-terminal G | 1.06 |
| G47A + C-terminal G | 1.00 |
| E350N + G47A + C-terminal G | 0.98 |
| D653K + G47A + C-terminal G | 0.96 |
| E350K + G47A + C-terminal G | 0.96 |
| D351V + E350K + K387S + G47A + C-terminal G | 0.93 |
| D653H + G47A + C-terminal G | 0.93 |
| E350K + K387H + G47A + C-terminal G | 0.89 |
| D653Y + G47A + C-terminal G | 0.89 |
| D653T + G47A + C-terminal G | 0.82 |
| D351V + E350A + K387S + G47A + C-terminal G | 0.76 |
| E350K + K387N + G47A + C-terminal G | 0.75 |
| E350N + K387N + G47A + C-terminal G | 0.75 |
| D653Q + G47A + C-terminal G | 0.68 |
| D351V + E350K + K387H + G47A + C-terminal G | 0.68 |
| D653S + G47A + C-terminal G | 0.67 |
| G884P + G47A | 0.67 |
| K387S + G47A + C-terminal G | 0.66 |
| D653A + G47A + C-terminal G | 0.65 |
| E350N + K387S + G47A + C-terminal G | 0.65 |
| D351V + E350A + K387H + G47A + C-terminal G | 0.64 |
| D351V + E350N + K387S + G47A + C-terminal G | 0.64 |
| P657A + G47A + C-terminal G | 0.63 |
| G884T + K387N + G47A | 0.60 |
| D351V + E350A + K387N + G47A + C-terminal G | 0.60 |
| D351V + E350W + K387H + G47A + C-terminal G | 0.58 |
| D351V + E350K + K387N + G47A + C-terminal G | 0.58 |
| D653N + G47A + C-terminal G | 0.56 |
| D653L + G47A + C-terminal G | 0.50 |
| E350A + K387N + G47A + C-terminal G | 0.49 |
| E350W + K387N + G47A + C-terminal G | 0.46 |
| D653G + G47A + C-terminal G | 0.42 |
| E350W + K387H | 0.41 |
| G884P + K387N + G47A | 0.24 |

41 of the 42 tested multi-substitution variants as shown in Table 7 produced higher relative amounts of percent capped RNA than the control polymerase variant (G47A+C-terminal G) or a wild-type RNA polymerase in the presence of GAG trinuc (FIG. 12). Several variants produced more than 85% capped RNA, including G47A+K387N+C-terminal T; E350W+K387N+G47A+C-terminal G; D351V+E350W+K387H+G47A+C-terminal G; G47A+D653T+C-terminal A; D351V+E350W+G47A+C-terminal G; D351V+E350K+K387N+G47A+C-terminal G; K387N+G47A+C-terminal G; D351V+E350K+K387S+G47A+C-terminal G; and D351V+E350A+K387N+G47A+C-terminal G.

Example 11. Multi-Substitution RNA Polymerase Variants Produce RNA Products with High Levels of Capping Efficiency at Low Concentrations of GGAG Cap Analog In vitro transcription reactions were performed using DNA template, 6 mM equimolar NTPs, a variable amount of GGAG tetranucleotide cap analog (0.6 mM/0.1:1 GGAG:

NTP; 0.8 mM; 1.0 mM; 1.2 mM/0.2:1 GGAG:NTP; 1.4 mM; or 1.6 mM) and 0.025 mg/mL T7 RNA polymerase—(1) G47A+C-terminal G (control polymerase variant; G47A+C-terminal G); (2) D563T+G47A+C-terminal G; (3) D653W+G47A; (4) E350W+D351V+G47A+C-terminal G; (5) D653T+G47A+C-terminal S (G884S); (6) E350W+K387N+G47A+C-terminal G; or (7) D653T+K387N+G47A+C-terminal G.

Following the IVT reaction, mRNA products were oligo-dT purified before being analyzed by LC-MS to determine the % capped RNA (i.e., percent of transcribed RNA comprising a cap) and by HPLC to determine the RNA yield of the reaction.

All tested multi-substitution variants produced RNA with percent capped RNA at higher levels than the control polymerase variant in the presence of GGAG cap analog, regardless of the concentration of the GGAG analog (FIG. 13B). Even at the lowest tested concentrations of GGAG cap analog (0.6 mM), all multi-substitution variants produced at least 80% capped RNA, considerably higher than the 45% capped RNA produced by the control polymerase variant. At 1.6 mM GGAG cap analog, all tested variants produced about 93-97% capped RNA.

Example 12. Multi-Substitution RNA Polymerase Variants Produce High-Quality RNA Products Regardless of DNA Template In vitro transcription reactions were performed using three different DNA templates (Construct 1, 2, and 3), 6 mM equimolar NTPs, 1.2 mM GGAG cap analog, and T7 RNA polymerase—(1) a G47A+C-terminal G RNA polymerase variant (control polymerase variant; G47A+C-terminal G); (2) a D653W+G47A RNA polymerase variant; (3) a D653T+K387N+G47A+C-terminal G RNA polymerase variant; (4) a E350W+D351V+G47A+C-terminal G RNA polymerase variant; (5) a E350W+K387N+G47A+C-terminal G RNA polymerase variant; or (6) a D653T+G47A+C-terminal G RNA polymerase variant.

Following the IVT reaction, mRNA products were oligo-dT purified before being analyzed by LC-MS to determine the % capped RNA (i.e., percent of transcribed RNA comprising a cap) and by HPLC to determine the RNA yield of the reaction.

All tested multi-substitution variants produced RNA with 90-95% capped RNA in the presence of GGAG tetranuc (FIG. 14A) for all three DNA templates. Each variant produced percent capped RNA at higher levels than the control polymerase variant.

A Tris RP (reverse-phase) method was used to assess percent tailed RNA (i.e., percent of transcribed RNA comprising a polyA tail). Multi-substitution variants produced RNA with comparable % tailing relative to control variant (≥90% tailed) for all three DNA templates (FIG. 14B).

A reverse-phase HPLC method was used to assess purity of transcribed RNA. Multi-substitution variants produced RNA with comparable purity relative to control variant and WT polymerase (about 95% purity) for all three DNA templates (FIG. 14C).

The 3' homogeneity of RNA transcripts produced from Construct 1 were measured using a RNAse T1 digest. RNA produced using the multi-substitution variants had higher percent 3' end homogeneity relative to control polymerase variant (FIG. 14D), with about 95% of total RNA having 3' homogeneity.

A standard dsRNA ELISA was used to assess dsRNA contaminants (e.g., longer than 40 nucleotide base pairs) following IVT reactions in this Example. All IVT reaction mixtures resulting from multi-substitution variants and the control variant contained less than −0.015% w/w dsRNA (FIG. 14E) for all three DNA templates. In particular, IVT reaction mixtures resulting from the D653T+K387N+G47A+C-terminal G RNA polymerase variant; the E350W+D351V+G47A+C-terminal G RNA polymerase variant; the E350W+K387N+G47A+C-terminal G RNA polymerase variant; and the D653T+G47A+C-terminal G RNA polymerase variant comprised less than 0.005% w/w dsRNA for all three DNA templates.

Example 13. Multi-Substitution RNA Polymerase Variants Produce High-Quality RNA Products In vitro transcription reactions were performed using a DNA template, 6 mM equimolar NTPs, 1.5 mM GGAG cap analog, and a T7 RNA polymerase—(1) wild-type RNA polymerase; (2) G47A+C-terminal G RNA polymerase variant; (3) E350W+K387N RNA polymerase variant; (4) E350W+D351V RNA polymerase variant; or (5) K387N+D653T RNA polymerase variant; (6) E350W+K387N+D653T RNA polymerase variant; (7) E350W+D351V+G47A+C-terminal G RNA polymerase variant; or (8) K387N+D653T+G47A+C-terminal G RNA polymerase variant.

Following the IVT reaction, mRNA products were oligo-dT purified before being analyzed by LC-MS to determine the % capped RNA (i.e., percent of transcribed RNA comprising a cap) and by HPLC to determine the RNA yield of the reaction.

Most of the tested multi-substitution variants in this Example produced comparable yields of total RNA relative to the wild-type polymerase in the presence of GGAG tetranuc (FIG. 15A), with approximately 5 mg/mL total RNA.

All tested multi-substitution variants in this Example produced RNA with higher amounts of capped RNA in the presence of GGAG tetranuc (FIG. 15B) relative to the wild-type polymerase variant and the G47A+C-terminal G polymerase variant. 90-95% of the total RNA produced by each of E350W+K387N RNA polymerase variant; E350W+D351V RNA polymerase variant; K387N+D653T RNA polymerase variant; E350W+K387N+G47A+C-terminal G RNA polymerase variant; E350W+D351V+G47A+C-terminal G RNA polymerase variant; and K387N+D653T+G47A+C-terminal G RNA polymerase variant comprised the GGAG tetranuc cap.

A standard dsRNA ELISA was used to assess dsRNA (e.g., longer than 40 nucleotide base pairs) produced by IVT reactions in this Example. Double mutant polymerase variants (E350W+K387N; E350W+D351V; and K387N+D653T) produced approximately 0.4% to 0.6% wt/wt dsRNA/total RNA (FIG. 15C). The other mutant variants (E350W+K387N+G47A+C-terminal G; E350W+D351V+G47A+C-terminal G; and K387N+D653T+G47A+C-terminal G) produced less than 0.015% wt/wt dsRNA/total RNA.

A reverse-phase HPLC method was used to assess purity of transcribed RNA. All tested multi-substitution variants in this Example produced RNA with comparable purity relative to G47A+C-terminal G variant and wild-type polymerase (about 90% purity) (FIG. 15D).

A Tris RP (reverse-phase) method was used to assess percent tailed RNA (i.e., percent of transcribed RNA comprising a polyA tail). All tested multi-substitution variants in this Example produced RNA with comparable % tailing relative to G47A+C-terminal G variant and wild-type polymerase (≥85% tailed) (FIG. 15E).

Example 14. Multi-Substitution RNA Polymerase Variants do not Cause an Increase in Indels or Point Mutations in Produced RNA In vitro transcription reactions were performed using a DNA template, 6 mM equimolar NTPs, 1.5 mM GGAG cap analog, and a T7 RNA polymerase—(1) G47A+C-terminal G variant; (2) D653T+G47A+C-terminal G variant; (3) D653W+G47A variant; (4) E350W+K387N+G47A+C-terminal G variant; (5) E350W+D351V+G47A+C-terminal G variant; or (6) D653+K387N+G47A+C-terminal G variant.

The produced mRNAs were evaluated using Next Generation Sequencing to test for insertion and deletions (indels) as well as point mutations in the produced RNA sequence. Importantly, none of the tested polymerase variants produced mRNA with significant numbers of indels or point mutations. All of the tested variants produced mRNA with 0.0-0.4% indels, below the threshold for indel percentage associated with wild-type RNA polymerase. Accordingly, this Example demonstrated that none of the tested polymerase variants or their individual mutations negatively impact the fidelity of the enzyme.

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

It should also be understood that, unless clearly indicated to the contrary, in any methods claimed herein that include more than one step or act, the order of the steps or acts of the method is not necessarily limited to the order in which the steps or acts of the method are recited.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03.

SEQUENCE LISTING (247 sequences)

SEQ ID NO: 1 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 2 - protein, 883 aa, Artificial Sequence
  Synthetic Polypeptide
  misc_feature (47)..(47): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMXEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 3 - protein, 883 aa, Artificial Sequence
  Synthetic Polypeptide
  misc_feature (350)..(350): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVXDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 4 - protein, 883 aa, Artificial Sequence
  Synthetic Polypeptide
  misc_feature (351)..(351): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEXIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 5 - protein, 883 aa, Artificial Sequence
  Synthetic Polypeptide
  misc_feature (387)..(387): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRXDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 6 - protein, 883 aa, Artificial Sequence
  Synthetic Polypeptide
  misc_feature (394)..(394): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSXRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 7 - protein, 883 aa, Artificial Sequence
  Synthetic Polypeptide
  misc_feature (425)..(425): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGXVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 8 - protein, 883 aa, Artificial Sequence
  Synthetic Polypeptide
  misc_feature (427)..(427): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVXAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 9 - protein, 883 aa, Artificial Sequence
  Synthetic Polypeptide
  misc_feature (437)..(437): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGXDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 10 - protein, 883 aa, Artificial Sequence
  Synthetic Polypeptide
  misc_feature (441)..(441): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTXGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 11 - protein, 883 aa, Artificial Sequence
  Synthetic Polypeptide
  misc_feature (632)..(632): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKXSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 12 - protein, 883 aa, Artificial Sequence
  Synthetic Polypeptide
  misc_feature (811)..(811): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIXDSFGTIPADAANLFKAVRETMVDTYESCDVLADFYDQFADQLHESQLDKMPALPAKGNLNLRDILESDFAFA

SEQ ID NO: 13 - protein, 883 aa, Artificial Sequence
  Synthetic Polypeptide
  misc_feature (880)..(880): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDXAFA

SEQ ID NO: 14 - protein, 884 aa, Artificial Sequence
  Synthetic Polypeptide
  misc_feature (884)..(884): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAX

SEQ ID NO: 15 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 16 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVKDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 17 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVNDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 18 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVADIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 19 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 20 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEVIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 21 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 22 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 23 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 24 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVKDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 25 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVNDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 26 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVADIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 27 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 28 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEVIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 29 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 30 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 31 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 32 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVKDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 33 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVNDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 34 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVADIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 35 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 36 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEVIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 37 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 38 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 39 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 40 - protein, 884 aa, Artificial Sequence
  Synthetic Polypeptide
  misc_feature (350)..(350): Xaa can be Ala, Lys, Asn, or Trp
  misc_feature (387)..(387): Xaa can be Ser, His, or Asn
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVXVIPAIEREELPMKPEDIDMNPEALTAWKRAAAAVYRXDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 41 - protein, 884 aa, Artificial Sequence
  Synthetic Polypeptide
  misc_feature (437)..(437): Xaa can be Thr, Tyr, Ile, or Phe
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGXDMTRGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 42 - protein, 884 aa, Artificial Sequence
  Synthetic Polypeptide
  misc_feature (884)..(884): Xaa can be Ala, Ser, Thr, or Pro
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDYAFAX

SEQ ID NO: 43 - protein, 884 aa, Artificial Sequence
  Synthetic Polypeptide
  misc_feature (632)..(632): Xaa can be Lys or Thr
  misc_feature (653)..(653): Xaa can be Thr or Lys
  misc_feature (657)..(657): Xaa can be Trp, Arg, or Ala
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKXSVMTLAYGSKEFGFRQQVLEXTIQXAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 44 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 45 - protein, 883 aa, Artificial Sequence
  Synthetic Polypeptide
  misc_feature (506)..(506): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQXSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 46 - protein, 883 aa, Artificial Sequence
  Synthetic Polypeptide
  misc_feature (628)..(628): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRXVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 47 - protein, 883 aa, Artificial Sequence
  Synthetic Polypeptide
  misc_feature (653)..(653): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEXTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 48 - protein, 883 aa, Artificial Sequence
  Synthetic Polypeptide
  misc_feature (657)..(657): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQXAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 49 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQWSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 50 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRWVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 51 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 52 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 53 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQWSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 54 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRWVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 55 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 56 - protein, 883 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 57 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQWSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 58 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRWVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 59 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 60 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 61 - protein, 884 aa, Artificial Sequence; identical to SEQ ID NO: 39
  Synthetic Polypeptide

SEQ ID NO: 62 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAT

SEQ ID NO: 63 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAT

SEQ ID NO: 64 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAS

SEQ ID NO: 65 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAS

SEQ ID NO: 66 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAP

SEQ ID NO: 67 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAP

SEQ ID NO: 68 - protein, 884 aa, Artificial Sequence; identical to SEQ ID NO: 59
  Synthetic Polypeptide

SEQ ID NO: 69 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 70 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAT

SEQ ID NO: 71 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAT

SEQ ID NO: 72 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAS

SEQ ID NO: 73 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAS

SEQ ID NO: 74 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAP

SEQ ID NO: 75 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAP

SEQ ID NO: 76 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 77 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 78 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAT

SEQ ID NO: 79 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAT

SEQ ID NO: 80 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAS

SEQ ID NO: 81 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAS

SEQ ID NO: 82 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAP

SEQ ID NO: 83 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAP

SEQ ID NO: 84 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 85 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 86 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAT

SEQ ID NO: 87 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAT

SEQ ID NO: 88 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAS

SEQ ID NO: 89 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAS

SEQ ID NO: 90 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAP

SEQ ID NO: 91 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAP

SEQ ID NO: 92 - protein, 884 aa, Artificial Sequence; identical to SEQ ID NO: 37
  Synthetic Polypeptide

SEQ ID NO: 93 - protein, 884 aa, Artificial Sequence; identical to SEQ ID NO: 38
  Synthetic Polypeptide

SEQ ID NO: 94 - protein, 884 aa, Artificial Sequence; identical to SEQ ID NO: 34
  Synthetic Polypeptide

SEQ ID NO: 95 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVADIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 96 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVADIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 97 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVADIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 98 - protein, 884 aa, Artificial Sequence; identical to SEQ ID NO: 32
  Synthetic Polypeptide

SEQ ID NO: 99 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVKDIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 100 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVKDIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 101 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVKDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 102 - protein, 884 aa, Artificial Sequence; identical to SEQ ID NO: 33
  Synthetic Polypeptide

SEQ ID NO: 103 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVNDIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 104 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVNDIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 105 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVNDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 106 - protein, 884 aa, Artificial Sequence; identical to SEQ ID NO: 35
  Synthetic Polypeptide

SEQ ID NO: 107 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWDIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 108 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWDIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 109 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 110 - protein, 884 aa, Artificial Sequence; identical to SEQ ID NO: 36
  Synthetic Polypeptide

SEQ ID NO: 111 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEVIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 112 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEVIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 113 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEVIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 114 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVAVIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 115 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVAVIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 116 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVAVIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 117 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVAVIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 118 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVKVIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 119 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVKVIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 120 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVKVIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 121 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVKVIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 122 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVNVIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 123 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVNVIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 124 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVNVIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 125 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVNVIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 126 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWVIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 127 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWVIPAIEREELPMKPEDIDMNPEALTAWKRAAAAVYRSDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 128 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWVIPAIEREELPMKPEDIDMNPEALTAWKRAAAAVYRHDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 129 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWVIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 130 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEATIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 131 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEFTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 132 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEGTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 133 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEHTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 134 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEITIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 135 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLELTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 136 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEMTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 137 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLENTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 138 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEPTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 139 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEQTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 140 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLERTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 141 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLESTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 142 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEVTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 143 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEYTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 144 - protein, 884 aa, Artificial Sequence; identical to SEQ ID NO: 60
  Synthetic Polypeptide

SEQ ID NO: 145 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 146 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 147 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 148 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 149 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEWTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 150 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 151 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 152 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 153 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 154 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 155 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEKTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 156 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGTDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 157 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGYDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 158 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGIDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 159 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGFDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 160 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTRGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 161 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGTDMTRGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 162 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGYDMTRGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 163 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGIDMTRGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 164 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGFDMTRGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 165 - protein, 884 aa, Artificial Sequence; identical to SEQ ID NO: 58
  Synthetic Polypeptide

SEQ ID NO: 166 - protein, 884 aa, Artificial Sequence; identical to SEQ ID NO: 57
  Synthetic Polypeptide

SEQ ID NO: 167 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQWSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRWVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 168 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQFSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 169 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQFSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRWVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 170 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQYSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 171 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQYSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRWVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 172 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQRSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 173 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQRSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRWVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 174 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQLSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 175 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQLSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRWVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 176 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLECTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 177 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEETIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 178 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 179 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 180 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEDTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 181 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEDTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 182 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEDTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 183 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEDTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 184 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEDTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 185 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEDTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 186 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 187 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEWTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 188 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEWTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 189 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEWTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 190 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEWTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 191 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEWTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 192 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEWTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 193 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEWTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 194 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEFTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 195 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEFTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 196 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEFTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 197 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEFTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 198 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEFTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 199 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEFTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 200 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEFTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 201 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEFTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 202 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEFTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 203 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEFTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 204 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEFTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 205 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEYTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 206 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEYTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 207 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEYTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 208 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEYTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 209 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEYTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 210 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEYTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 211 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEYTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 212 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEYTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 213 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEYTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 214 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEYTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 215 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEYTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 216 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 217 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 218 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLETTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 219 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLETTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 220 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLETTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 221 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLETTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 222 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLETTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 223 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLETTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 224 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEKTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 225 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEKTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 226 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEKTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 227 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEKTIQWAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 228 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEKTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 229 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEKTIQRAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 230 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKKSVMTLAYGSKEFGFRQQVLEKTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 231 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKTSVMTLAYGSKEFGFRQQVLEKTIQAAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFAG

SEQ ID NO: 232 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDYAFAG

SEQ ID NO: 233 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDYAFAS

SEQ ID NO: 234 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDYAFAT

SEQ ID NO: 235 - protein, 884 aa, Artificial Sequence
  Synthetic Polypeptide
MNTINIAKNDFSDIELAAIPFNTLADHYGERLAREQLALEHESYEMAEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDYAFAP

SEQ ID NO: 236 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWVIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 237 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 238 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVWDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 239 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEVIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 240 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEVIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 241 - protein, 883 aa, Artificial Sequence
  Synthetic Polypeptide
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRNDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLETTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 242 - protein, 883 aa, Artificial Sequence
  Synthetic Polypeptide
  misc_feature (350)..(351): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVXXIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 243 - protein, 883 aa, Artificial Sequence
  Synthetic Polypeptide
  misc_feature (350)..(350): Xaa can be Arg, Lys, His, Glu, Asp, Gln, Asn, Thr, Ser, Cys, Gly, Ala, Val, Leu, Ile, Met, Pro, Tyr, Trp, or Phe
  misc_feature (387)..(387): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVXDIPAIEREELPMKPEDIDMNPEALTAWKRAAAAVYRXDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 244 - protein, 883 aa, Artificial Sequence
  Synthetic Polypeptide
  misc_feature (350)..(350): Xaa can be Arg, Lys, His, Glu, Asp, Gln, Asn, Thr, Ser, Cys, Gly, Ala, Val, Leu, Ile, Met, Pro, Tyr, Trp, or Phe
  misc_feature (653)..(653): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVXDIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEXTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 245 - protein, 883 aa, Artificial Sequence
  Synthetic Polypeptide
  misc_feature (351)..(351): Xaa can be Arg, Lys, His, Glu, Asp, Gln, Asn, Thr, Ser, Cys, Gly, Ala, Val, Leu, Ile, Met, Pro, Tyr, Trp, or Phe
  misc_feature (387)..(387): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEXIPAIEREELPMKPEDIDMNPEALTAWKRAAAAVYRXDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEDTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 246 - protein, 883 aa, Artificial Sequence
  Synthetic Polypeptide
  misc_feature (351)..(351): Xaa can be Arg, Lys, His, Glu, Asp, Gln, Asn, Thr, Ser, Cys, Gly, Ala, Val, Leu, Ile, Met, Pro, Tyr, Trp, or Phe
  misc_feature (653)..(653): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEXIPAIEREELPMKPEDIDMNPEALTAWKRAAAAVYRKDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEXTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

SEQ ID NO: 247 - protein, 883 aa, Artificial Sequence
  Synthetic Polypeptide
  misc_feature (387)..(387): Xaa can be Arg, Lys, His, Glu, Asp, Gln, Asn, Thr, Ser, Cys, Gly, Ala, Val, Leu, Ile, Met, Pro, Tyr, Trp, or Phe
  misc_feature (653)..(653): Xaa can be Arg, Lys, His, Glu, Asp, Gln, Asn, Thr, Ser, Cys, Gly, Ala, Val, Leu, Ile, Met, Pro, Tyr, Trp, or Phe
MNTINIAKNDFSDIELAAIPFNTLADHYGERLAREQLALEHESYEMGEARFRKMFERQLKAGEVADNAAAKPLITTLLPKMIARINDWFEEVKAKRGKRPTAFQFLQEIKPEAVAYITIKTTLACLTSADNTTVQAVASAIGRAIEDEARFGRIRDLEAKHFKKNVEEQLNKRVGHVYKKAFMQVVEADMLSKGLLGGEAWSSWHKEDSIHVGVRCIEMLIESTGMVSLHRQNAGVVGQDSETIELAPEYAEAIATRAGALAGISPMFQPCVVPPKPWTGITGGGYWANGRRPLALVRTHSKKALMRYEDVYMPEVYKAINIAQNTAWKINKKVLAVANVITKWKHCPVEDIPAIEREELPMKPEDIDMNPEALTAWKRAAAAVYRXDKARKSRRISLEFMLEQANKFANHKAIWFPYNMDWRGRVYAVSMFNPQGNDMTKGLLTLAKGKPIGKEGYYWLKIHGANCAGVDKVPFPERIKFIEENHENIMACAKSPLENTWWAEQDSPFCFLAFCFEYAGVQHHGLSYNCSLPLAFDGSCSGIQHFSAMLRDEVGGRAVNLLPSETVQDIYGIVAKKVNEILQADAINGTDNEVVTVTDENTGEISEKVKLGTKALAGQWLAYGVTRSVTKRSVMTLAYGSKEFGFRQQVLEXTIQPAIDSGKGLMFTQPNQAAGYMAKLIWESVSVTVVAAVEAMNWLKSAAKLLAAEVKDKKTGEILRKRCAVHWVTPDGFPVWQEYKKPIQTRLNLMFLGQFRLQPTINTNKDSEIDAHKQESGIAPNFVHSQDGSHLRKTVVWAHEKYGIESFALIHDSFGTIPADAANLFKAVRETMVDTYESCDVLADFYDQFADQLHESQLDKMPALPAKGNLNLRDILESDFAFA

What is claimed is:

1. A ribonucleic acid (RNA) polymerase variant comprising an RNA polymerase that comprises an amino acid substitution at position D351 relative to an RNA polymerase comprising the amino acid sequence of SEQ ID NO: 1, wherein the RNA polymerase variant has at least 95% identity to the amino acid sequence of SEQ ID NO: 1, and wherein the amino acid substitution at position D351 is selected from D351C, D351I, D351K, D351L, D351M, D351P, D351Q, D351R, D351S, D351T, D351V, and D351W.

2. A ribonucleic acid (RNA) polymerase variant comprising an RNA polymerase that comprises an amino acid substitution at positions E350 and D351, relative to a wild-type RNA polymerase comprising the amino acid sequence of SEQ ID NO: 1, wherein the RNA polymerase variant has at least 95% identity to the amino acid sequence of SEQ ID NO: 1.

3. A method comprising producing a mRNA in an in vitro transcription reaction that comprises a deoxyribonucleic acid (DNA), nucleoside triphosphates, and the RNA polymerase variant of claim 2.

4. A composition or kit comprising the RNA polymerase variant of claim 2 and an in vitro transcription (IVT) reaction component.

5. A nucleic acid encoding the RNA polymerase variant of claim 2.

6. The RNA polymerase variant of claim 2, wherein the amino acid substitution at position E350 is selected from E350W, E350A, E350K, and E350N.

7. The RNA polymerase variant of claim 6, wherein the amino acid substitution at position E350 is E350W.

8. The RNA polymerase variant of claim 2, wherein the amino acid substitution at position D351 is D351V.

9. The RNA polymerase variant of claim 7, wherein the amino acid substitution at position D351 is D351V.

10. The RNA polymerase variant of claim 2, further comprising a C-terminal G.

11. The RNA polymerase variant of claim 9, further comprising a C-terminal G.

12. The RNA polymerase variant of claim 2, further comprising an amino acid substitution at position G47, relative to a wild-type RNA polymerase comprising the amino acid sequence of SEQ ID NO: 1.

13. The RNA polymerase variant of claim 12, wherein the amino acid substitution at position G47 is G47A.

14. The RNA polymerase variant of claim 9, further comprising an amino acid substitution at position G47, relative to a wild-type RNA polymerase comprising the amino acid sequence of SEQ ID NO: 1.

15. The RNA polymerase variant of claim 14, wherein the amino acid substitution at position G47 is G47A.

16. The RNA polymerase variant of claim 1, wherein the RNA polymerase variant has at least 98% identity to the amino acid sequence of SEQ ID NO: 1.

17. A ribonucleic acid (RNA) polymerase variant comprising an RNA polymerase that comprises a C-terminal G and an amino acid substitution at positions G47, E350, and D351, relative to a wild-type RNA polymerase comprising the amino acid sequence of SEQ ID NO: 1.

18. The RNA polymerase variant of claim 17, wherein the amino acid substitution at position G47 is G47A, the amino acid substitution at position E350 is E350W, and the amino acid substitution at position D351 is D351V.

19. A ribonucleic acid (RNA) polymerase variant comprising an RNA polymerase that comprises the amino acid sequence of SEQ ID NO: 126.

20. The RNA polymerase variant of claim 6, wherein the amino acid substitution at position E350 is E350A.

21. The RNA polymerase variant of claim 1, wherein the amino acid substitution at position D351 is D351V.

22. The RNA polymerase variant of claim 1, further comprising an amino acid substitution at position K387.

23. The RNA polymerase variant of claim 22, wherein the amino acid substitution at position K387 is selected from K387H, K387N, and K387S.

24. The RNA polymerase variant of claim 1, comprising amino acid substitutions G47A, E350A, D351V, and K387H, and further comprising a C-terminal G.

25. The RNA polymerase variant of claim 24, comprising the amino acid sequence of SEQ ID NO: 116.

26. The RNA polymerase variant of claim 1, comprising amino acid substitutions G47A, E350A, D351V, and K387N, and further comprising a C-terminal G.

27. The RNA polymerase variant of claim 26, comprising the amino acid sequence of SEQ ID NO: 117.

28. The RNA polymerase variant of claim 1, comprising amino acid substitutions G47A, E350A, D351V, and K387S, and further comprising a C-terminal G.

29. The RNA polymerase variant of claim 28, comprising the amino acid sequence of SEQ ID NO: 115.

30. The RNA polymerase variant of claim 2, wherein the RNA polymerase variant has at least 98% identity to the amino acid sequence of SEQ ID NO: 1.

31. The RNA polymerase variant of claim 17, wherein the RNA polymerase variant has at least 95% identity to the amino acid sequence of SEQ ID NO: 1.

* * * * *